United States Patent 7,745,391 (HUMAN THROMBOSPONDIN POLYPEPTIDE) - sequence listing, part 188

SEQ ID NO: 453255 - DNA, 3145 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgaaatgttttttggtggaaaaaccaaattttcttcttaatagtcctctttatactccctctctccatttatttttcg

SEQ ID NO: 453256 - DNA, 3382 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagagaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453257 - DNA, 3524 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453258 - DNA, 1971 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgcgtccgtccgacggacgcattcactgcactcataaggtggtgtgaccagtgtgaactctcttatgaacacagaatgcagtgctgtgggtagatgactgcccataatcactgcattcattatggcctttctcctgtgtgcactctctggtgtgcaatgaggtggtccttcttgctatgtactttctgacaatcctcacactcatatggcttttctccagtgtgaactctgctgta

SEQ ID NO: 453259 - DNA, 3921 bp, Homo sapiens
gcggccgcggcaggtgcaggtgctggcgccgtgcagggcgcggcacgcgggggttcggggggatgcccaggcccggtgagctcgctctccgcctgggcacttgggctccgggcccttgggggcggcgtgtgggggggactttggcgacccgggtcagccggccgccccctgggctgctggtgggcgtcgggcggcggctcctcccccgggcacgggcgcgttacacattaactgcgcggtcccgcgcgcccggggcagggagcccgagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagagaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453260 - DNA, 4078 bp, Homo sapiens
gcggccgcggcaggtgcaggtgctggcgccgtgcagggcgcggcacgcgggggttcggggggatgcccaggcccggtgagctcgctctccgcctgggcacttgggctccgggcccttgggggcggcgtgtgggggggactttggcgacccgggtcagccggccgccccctgggctgctggtgggcgtcgggcggcggctcctcccccgggcacgggcgcgttacacattaactgcgcggtcccgcgcgcccggggcagggagcccgagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaaggtggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453261 - DNA, 2576 bp, Homo sapiens
aatggaataaccaatgttaacctgttttaattgaattgcattttgacgaattatcaataaaaatgatgctggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453262 - DNA, 2634 bp, Homo sapiens
  misc_feature (1)..(1): n is a, c, g, or t
  misc_feature (69)..(69): n is a, c, g, or t
  misc_feature (101)..(102): n is a, c, g, or t
  misc_feature (122)..(122): n is a, c, g, or t
  misc_feature (136)..(136): n is a, c, g, or t
  misc_feature (153)..(153): n is a, c, g, or t
  misc_feature (160)..(160): n is a, c, g, or t
  misc_feature (165)..(165): n is a, c, g, or t
  misc_feature (169)..(169): n is a, c, g, or t
  misc_feature (175)..(175): n is a, c, g, or t
  misc_feature (178)..(178): n is a, c, g, or t
  misc_feature (185)..(185): n is a, c, g, or t
  misc_feature (205)..(205): n is a, c, g, or t
  misc_feature (212)..(212): n is a, c, g, or t
  misc_feature (226)..(227): n is a, c, g, or t
  misc_feature (230)..(230): n is a, c, g, or t
  misc_feature (236)..(236): n is a, c, g, or t
  misc_feature (239)..(239): n is a, c, g, or t
  misc_feature (241)..(241): n is a, c, g, or t
  misc_feature (248)..(249): n is a, c, g, or t
  misc_feature (254)..(255): n is a, c, g, or t
  misc_feature (257)..(259): n is a, c, g, or t
  misc_feature (262)..(263): n is a, c, g, or t
  misc_feature (265)..(266): n is a, c, g, or t
  misc_feature (268)..(268): n is a, c, g, or t
naaaccaccaaaaaccaaaaaggcagcgaaggaaaccgcaacgacagcaaggcaacaaaaggcgaggcnaaacggagaaaaaagaaaagaacaaccacaanngcaaaccgccaaacaaaaangggaaaaaccccanaaaacaaagaaaacaanaacaacncatancacnccaacnaanaaccaantaacgcgcagaaacaaaagncgaaaanaagcaaaacaccannaantataantcnanaagcaannaacanncnnnaannannanaaaaagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453263 - DNA, 2156 bp, Homo sapiens
acctcttacctcgccatatatgtacgtataatgatgttaatcattaccgtaattatctgattgtccagcagtttctgggaagtgttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453264 - DNA, 242 bp, Homo sapiens
cttggacaggaattggaagaactcacagctagtctatttgaggttggtctatttacatcttggccaacagcaacatcttgacttttatatattgacaaaattgtattttgagggaatcttgaaaaatatttgcttagcttcatgtatatttataagtcctctaagcaaaagagaaatctttaagcaatgtagagtttacaacttaagatgatgtgaaaagaaataaaaaacatctatgggcc

SEQ ID NO: 453265 - DNA, 3014 bp, Homo sapiens
  misc_feature (1)..(1): n is a, c, g, or t
ntttttacctaagcaagcctgggcaatggcgggcgtccctcccccagcctcgttgccgccttgcagtttgatctcagactgctgtgctagcaatcagcgagattccgtgggcgtaggaccctctgagccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453266 - DNA, 2090 bp, Homo sapiens
  misc_feature (1982)..(1982): n is a, c, g, or t
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaagtcgacgcggccgcgaatttagtagtagagcgacctggaatccgacggtactgcagcgtacactttctataggagtcgatagagctgcgaacatgtcaagtgttctggtgaatgtacgcgcnatcaccacatcgagcgacataatgtagctggggctagagggcacccatatgctgccatgcgctcatcggactgcggcacgcatagacgcacgcggaagcgtcgatggc

SEQ ID NO: 453267 - DNA, 3580 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453268 - DNA, 4163 bp, Homo sapiens
gcggccgcggcaggtgcaggtgctggcgccgtgcagggcgcggcacgcgggggttcggggggatgcccaggcccggtgagctcgctctccgcctgggcacttgggctccgggcccttgggggcggcgtgtgggggggactttggcgacccgggtcagccggccgccccctgggctgctggtgggcgtcgggcggcggctcctcccccgggcacgggcgcgttacacattaactgcgcggtcccgcgcgcccggggcagggagcccgagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453269 - DNA, 4063 bp, Homo sapiens
gcggccgcggcaggtgcaggtgctggcgccgtgcagggcgcggcacgcgggggttcggggggatgcccaggcccggtgagctcgctctccgcctgggcacttgggctccgggcccttgggggcggcgtgtgggggggactttggcgacccgggtcagccggccgccccctgggctgctggtgggcgtcgggcggcggctcctcccccgggcacgggcgcgttacacattaactgcgcggtcccgcgcgcccggggcagggagcccgagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453270 - DNA, 4027 bp, Homo sapiens
gcggccgcggcaggtgcaggtgctggcgccgtgcagggcgcggcacgcgggggttcggggggatgcccaggcccggtgagctcgctctccgcctgggcacttgggctccgggcccttgggggcggcgtgtgggggggactttggcgacccgggtcagccggccgccccctgggctgctggtgggcgtcgggcggcggctcctcccccgggcacgggcgcgttacacattaactgcgcggtcccgcgcgcccggggcagggagcccgagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaacaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagaaatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccatacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaacc

SEQ ID NO: 453271 - DNA, 1172 bp, Homo sapiens
ctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggtaactcatcaaggactgtcccctctgactctgttgatacttgttagttctca

SEQ ID NO: 453272 - DNA, 516 bp, Homo sapiens
caggatcgagctcggtacccaattcatagatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctatgatttagaggccacggaggatcactttgtgaggcttgccaatgcattgcctttgtttttctgaccagatgcagataaggctactcgtattccaggaactgtttgtgatagaacagcaagtacccttcgctgtccaggacgtacttgatgctggccttggtgatgatggaatcgtcacacttgaaccactggtctatgtgctgccggataaa

SEQ ID NO: 453273 - DNA, 543 bp, Homo sapiens
ccaaaaaattctaaggtagaaaatgtgaatgtttagttaatttagtaacacattacaaaaattcaaaagtatttacattgaaagaaccacattacaaaaattctaaagtgttttaaattggaagacttagaataaaagaaatatttgagacaacaattttaacaaaatgtcttttgtgtcaccgctagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaaaaaat

SEQ ID NO: 453274 - DNA, 951 bp, Homo sapiens
ggcgtccttgtgaactttccgcttggatcctgactctgctgttagtagcctatgaccttggatgaaatgtaagggaatagaaactgaagctatctgtaaagtgaaagagctggtgcctgccttattgggagcctctgggtttatgtatgagtcagatgcgtagagttgctcaccatggagggcccaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagaaggtaaggctcgcagggctgtgggtctgcctcatgttggtgtgttggcctgttcctgactggtcaccaggtaagtgtgtgcgtcctgaggagtcagcgggcagacaggcagctggagcgccataccaaccaccgtatctgtatcggacccagcatagccccagcagaagccatggtccctggattggcgtccagcagtagacactgtgcttaactctgcgaggatgtgaagaagcatgtgtgtgaccctccagcatctccgcaagggctgcttcaggatgaagccgctgaagaaagaagaaagaaagaaagtgtgtggaaaagagcaggacctcaggaagctcctccattctaactgtctggagaggatactttcatttgtaacatgccgtagtcacctcatgtaatttctgtatgaatggccttttagctcattatgttcgtatttttttcctgtttgtttctaacttctctgtattacatataagggcattttctaaacttttcaccacatg

SEQ ID NO: 453275 - DNA, 1136 bp, Homo sapiens
acgccatacgccggggcggggccgagagtttggagccccggagtggggtgtcggcgcctcattcgggtggagctgagccggagacagggtaaccgtgcgctgtcgccgcgcccgtcccagtgccgggtgtcgcggcgcttggcggcccggggttggagatcgcggtaaagggggaggccgccgcgcccttggtgctgcgggcgccgcggtgacaggggagtggagctggatggagtggggctcacggagggtggtaggagggacgggacctgatggatggccgtggcagccaatggagccgcggggcttgcccggcgggcggagattggcgggtacgggcgggctccgaggtcgcgcggggcgcggagcgacgcgccattggcggtgggcgagcggggggcgggcgcggcggcggatgtgagggagagggcggtgcgtccgcaggggtgacccccaaggtcgccgcgggcgtcacgtggttaggccgctctccgacggcgtccttcccgaccgggacgcactctccttcccgcctgtgaggaccgcgtcgctttgtccgaaagacagtgtggcctgctcgagttgcgtcggagcatctagctttggggtggccctgggtgggacttgcctgtttgggattaccgcgcagaccttggcgccccccccacacctgctgccagaagttgggtcgaacagattgaccgagatgaagcttatttctcgtagaaacatctttcaagcaccattttccctcgaaaatatatcagacattggatatgagttgtaatctactgagatttaatagaaaacttgccgcgccctcgccctgacctgggtgcgtcccacctgccatccccatccctttgcccagaacataggacttcgtgttagggtttccttgtgccttgtcttgcagtccgtactttgaggctgatttccaggtacactgctctgaacagctgggtttaggatgggtggcatgggataaagcctttttttgtaaggcagcactagttgcaacagtcaaactgtactttgccgtgtagacctaggagagtatgtaacactattgtagttttgtaaattagctgaggactggatcttgggaagttgaataaagatcactgtatgctcat

SEQ ID NO: 453276 - DNA, 442 bp, Homo sapiens
cgactctagaggtaccccgaggtgtctcagagcgcacgcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaaggttatgttcagagaaaagcttttttctccttatgcatttactgctttttcttttatcaaaagtatatggtgctaaattcatgt

SEQ ID NO: 453277 - DNA, 450 bp, Homo sapiens
ctctctctgtgggggatttggccgggtcatgggaccatagtggagggaaggtcagccggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccccccccccgagagagcgtcgacgctctctctgtggggggcctgcccccgctaaccggctttttgccccaatgggccattatcgaagaattcaccaaaaaccatagcctcatcatccccaccatcatagccaccatcaccctccttaacctctacttctacctacgcctaatctactccacctccatacactatctccccacacgagagagcgtcgggatcctctagatcacccagcacc

SEQ ID NO: 453278 - DNA, 4246 bp, Homo sapiens
acgccatacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaattactgggcctcgtttacaacgtcgtgactgggccctggcgtaccctttcgcctgc

SEQ ID NO: 453279 - DNA, 7909 bp, Homo sapiens
aatccattccatgggagttttctggattgcaaaataacgatgacttgcatagatgaatggttttgtgaagttggagctgaaattttgaaacaatgagagcataaatctctaggttttgctgctgaaagttggaaacaagagtctgaatctctagatctgaaaatctaaaacttgtcatttgtcttgttttcctaagaattgactgtgagtttttaagataaatttagaactttctaactttatttttggttgatagggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453280 - DNA, 6429 bp, Homo sapiens
gaatcgagctcggtaccaacgtcatatagcgggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453281 - DNA, 9659 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttgccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453282 - DNA, 4759 bp, Homo sapiens
ctagaggccacggagagcacatccacatgaatgccactcagtgggaaactctgactgattgtactaagtggctgggcagagaaggtaagaatgagattttaaagttgctttttctttcccacttctaatcttcataggatgagatgtttgggataagaaaagagcaaaaaaattgggtcagtgttttgctttttcatcgtgttaattgattccattttgggagcataatttctgccctaagttaatagaacatcatataactgttggacattaaatacttagatagaactgaataaatacttatgcaaggtaatacagttgtctctccgtaattcatagatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453283 - DNA, 4232 bp, Homo sapiens
ggcgtccttgtgaactttccgcttggatcctgactctgctgttagtagcctatgaccttggatgaaatgcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453284 - DNA, 4240 bp, Homo sapiens
acgccatacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtcaggggtcaccacattgcaaaaccttgatcctctcggaattagttgtgtaaattttgatgatgctccagtaactgtttcttcaaacgtggggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453285 - DNA, 10012 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453286 - DNA, 2854 bp, Homo sapiens
catctcatattgttcctgtgtgaattgtatccgctatatgcgtcgacgacagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453287 - DNA, 2679 bp, Homo sapiens
  misc_feature (4)..(4): n is a, c, g, or t
  misc_feature (9)..(9): n is a, c, g, or t
tgangatgntctagaggatccctcacgcccatgtcacaaggacgtggtgtacgattggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453288 - DNA, 1834 bp, Homo sapiens
agacctggggcagcagcaacacgatgccattctgccgcatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453289 - DNA, 9138 bp, Homo sapiens
  misc_feature (1880)..(1880): n is a, c, g, or t
  misc_feature (9015)..(9015): n is a, c, g, or t
  misc_feature (9031)..(9032): n is a, c, g, or t
  misc_feature (9034)..(9034): n is a, c, g, or t
  misc_feature (9048)..(9048): n is a, c, g, or t
  misc_feature (9053)..(9053): n is a, c, g, or t
  misc_feature (9060)..(9060): n is a, c, g, or t
  misc_feature (9062)..(9062): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctgtatgcnggcggaccagggtgtnncncacggaaagaaacnctgangagtgangntctggaaggcttcgacggacgttcagactttcgtaatgtgctagggtgtgggcctgcctcaacagtgatgcctgtt

SEQ ID NO: 453290 - DNA, 1595 bp, Homo sapiens
caagaaaaaaaggtatctcaggtttgcctcctgagtagctgggcccagctactcaggaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453291 - DNA, 6832 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaaggtaaactttctgctaaaaattaatgaaccataaatacctatttgtgccttgaaaagctagtaccagtttttttttatttttgtttccagattacttagagtgaattgggtgaatcaagagctgtttagtcactagacgtagctatttcttgcattttactttctgttcacgggacattgtgctgagcataagaatattctagagcctgctcatcagctgttccttagcttcttgctgcagttagggggctgatccagctctagaagaatggaggaggtctgctattatgctgattcttattgctggagtgggcctctgtgactgatggccatatattggatcccttaggtggaaggaaatagagaaaagctgagaaccctggtctggaccagtgaaatgctttctaggggcttccatttgctaaaagttgaaaattgagttcccaatcttgagccgtgtttttcatggtgctattgttattattcattgtcatcaggttcctccactgtgtggtagataggtacttgcacagccggtatgactctgtttttttatctctagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaaaaaat

SEQ ID NO: 453292 - DNA, 6955 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtaaggcgggtgctttacccgcacacgggaaagggtgcagtgttccttaggtcatgcctcatgggccctattggcctttctgagtgtatgttgtcactttacttatacctcctcaaatactaggtgctttctccctgctttgggaggctaaaaaacaaatacacaagaaaaagaaccaggctagccctatttgagcaaatctcccagcaccactaatgcctgccttataaaagggatccttatttcctttccttccttggcaagaaatatttgtgggcagggaaaacaagtcagtacccgggcatcaaggagaagtgctgcccatctgccagtgagcagtgactgggaggggtggtgcttttgggtggttgatgcccccttctcagttgctaacaactgaatactataagagaagaaaaccatactatagagtttggggatgtggaggcagggagaggcagctgagggtacagctgagcctac

SEQ ID NO: 453293 - DNA, 6795 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagaaggtaaggctcgcagggctgtgggtctgcctcatgttggtgtgttggcctgttcctgactggtcaccaggtaagtgtgtgcgtcctgaggagtcagcgggcagacaggcagctggagcgccataccaaccaccgtatctgtatcggacccagcatagccccagcagaagccatggtccctggattggcgtccagcagtagacactgtgcttaactctgcgaggatgtgaagaagcatgtgtgtgaccctccagcatctccgcaagggctgcttcaggatgaagccgctgaagaaagaagaaagaaagaaagtgtgtggaaaagagcaggacctcaggaagctcctccattctaactgtctggagaggatactttcatttgtaacatgccgtagtcacctcatgtaatttctgtatgaatggccttttagctcattatgttcgtatttttttcctgtttgtttctaacttctctgtattacatataagggcattttctaaacttttcaccacatg

SEQ ID NO: 453294 - DNA, 6154 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctagaataatcatagaggccacggaccttggagactgcacgaaaaagattgttggtggtgatgtccttccttgaagcatcatgttgtaattccgtgggcctctaatt

SEQ ID NO: 453295 - DNA, 5863 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttgtatcctttatgaaatcatgcacttgaatgatgaccttgaaatataggaactgttcacttattctcatattatttgggcaccaaaaccaggtggaaggagataaacttaattttttcccagtaaatgcctaatgtatttccaaatcatag

SEQ ID NO: 453296 - DNA, 5655 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcaggtaagaaccatgtgacttctctaaggtttttatgtttttggaaaatgttgataaaaataacagatgtggacctggtgcggtggctcacgcctataatcccagcactttgggaggccaaggcggatggatcacctgaggtcaagagttgaagaccatcctagccaacatggtgaaaccttgtgtgtactaaaaatacaaaaaaaatttagctgggcatggtggcacgtgcctgtgtgcccagctacttggggtggctgaggcaggagaattgcttgaacccaagaggcagaggttgtagtgagccaagatcacgccactgcattccagcctgggcaacagagggagactccatctgaaaaa

SEQ ID NO: 453297 - DNA, 3075 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctggtatatgcttaaaagccttcatgtcttgcaaacagctttgatgttttcatcttttgtaaactgagaatttgaaatagatgatctctgaagtcatttttcactgtaagattctctctctgtatctgaagtggtgttttcagtgaatcatttaaatgagagtattgtaagtaaaaacagactaaagtacagagagaatctcactgtcactgtgtttcactgcagggtcttttgtaggtaaagtgatctttctatcattttaacatctttaacatccctaactttaaagtacttttttgtccatcccccacctcataatatttttaaaaggacttactatagtgcttgatacatagtggtcaataaattttacttgttattattaccactaattattatttattgaatgcttactatgtatttggctcttttaaaagcacattgcatatattaatgcattcaatctattcaaaaatgtgttagatcttcttatttccatttaacaaataaagaagctgaaatacaacgaagttata

SEQ ID NO: 453298 - DNA, 530 bp, Homo sapiens
tcccaccttgaggccgctgaccccgtggtgatgggcaagaccaaagccgaacagttttactgtggcgacactgaagggaaaaaggtaaggcccagagagaggcgtgcaaggcagatcgtcaaggccccatgttccagcatggagttccgctcaccaacataacccagagccctgggtgcatctagactttaaaaaaatatttaaagtcggccgggcgcagtgtctcacgcctgtaatcccagcactttgggaggccgaggtgggcagatcacctgagttcgggagttggagaccagcctgaccaacatggagaaactccatctctactaaaaatacaaaattagctgggcgtggtggcgcgcgcctgtaatcccagctactcaggaggctgaggcaggagaatcgcttgaacccgggaggtggaggttgcagtgagccgagattacgccattgcactccagcctgggccaacaagagcgaaactctgtctcaaagaaaaaaataaataaataaaaaatatatgtatatgt

SEQ ID NO: 453299 - DNA, 487 bp, Homo sapiens
aatgtcataaatgggcgtcattttaataactactctcagaatatctttttctattccactttactttttcctctccacttaaccaactcatcattagaaactacaagtcccaggatgcactacacgatgaacgtcggatcgaggacctcgtgtctctgaagtggttgccctcgccttatttgaatgggaataatcccaatgaaaattgatgtttgtgacccagagcagattctggagccttttgtacgcctgggacggcccagcgtggaggggacagtgtggtgcctttttgttcaggcttcgctcaggtcagcctcaccctttcccggggcctccatgcggcagaagggctctgttagtgcgcctctaagatggcgacgcctttggcggtaaattcgggtaagtgtggccagacagaaagacgattgagctgagcgataaccaggtcttcatggagagacgagaccgtgaggtttctcggagtcta

SEQ ID NO: 453300 - DNA, 401 bp, Homo sapiens
aattagatttttcttgaaaactaaaaatgccttttaagatcatttcactctgcattttagattggctttgaatgcgcatgtaccggtgctgttattaatatataacaggtacttacagtctttgtaaaatcatagttctcaaaacttttttatggcaagaatatctgttcatgcacataaacaatataaaatattagaacctctcttcctagtttttaatgtttttgtttattataataatatgttttaaagcattctacattttataggaatattaagtgaacttgacgttgatgtaaatgaagggtctctaatggagctacagggacatattggaagattccaggtaactgattcttatttctttaaatagcagttataagacatgttacaaaatatac

SEQ ID NO: 453301 - DNA, 360 bp, Homo sapiens
ctgagtattatggtaaagttgaaggttacttccttcaacattatttataaaatgaattatgcatttatatataattttctacttctacctgttttttctattcctcttccttttcaatggcttaggtattgcagtttcttatttcacattctgataccatacaagcaattctgcgctgtcaggatgttagtgctgggtctttgcaggaattggctctgctgacaggaattataagtaaagcagcacttcctggtgagttgattatgttgaaaggatttttaataattctttaaagactgacataaattaatagaatgagtttttttgttactttgcagctatatatgacttatttgaaat

SEQ ID NO: 453302 - DNA, 438 bp, Homo sapiens
ggctaggaggttctctgtgtacaagtgacccaggtccctgaaggaagcacttcatgaccctatgaagagggcttctgcctggcacccactccatcccatcctcagtcacacttgattggagtacatttcagaacaagcctcctgcttatcccctccttctggctgaatgggcagtcggcagtcttcattcagccaggcctggttagaaatccccttgactgtgtgtttctgtatggaatagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtatgggtctggccctgggccatggggcagacattcccaggg

SEQ ID NO: 453303 - DNA, 6271 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaaaaaat

SEQ ID NO: 453304 - DNA, 1016 bp, Homo sapiens
  misc_feature (1016)..(1016): n is a, c, g, or t
acgccatacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgatcttgcagtttttcaagggaaccgactttcgaatgctaacagtaggaggggttctatgggctggattgagtctgaccctcgacaggttcttccaattggcccacaagcaaattttcaatccggggggacaggggaaaatccagggacgttacccatcttggacagggacaaattcatccggtcgaactggaaaaattgggcctatactggcgccagcaaaatagggggaggagagatccagtgtccaccacaagagaccttggagcatgcgccacggtagaaccccgggcagaagacagtggagaacccccgtggacaatagtgacggtcacaaaactcgcggagagcaacaggacccgtgaggccaaagtgaggcggcaccan

SEQ ID NO: 453305 - DNA, 809 bp, Homo sapiens
acgccatacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtgttggcctgttcctgactggtcaccaggtaagtgtgtgcgtcctgaggagtcagcgggcagacaggcagctggagcgccataccaaccaccgtatctgtatcggacccagcatagccccagcagaagccatggtccctggattggcgtccagcagtagacactgtgcttaactctgcgaggatgtgaagaagcatgtgtgtgaccctccagcatctccgcaagggctgcttcaggatgaagccgctgaagaaagaagaaagaaagaaagtgtgtggaaaagagcaggacctcaggaagctcctccattctaactgtctggagaggatactttcatttgtaacatgccgtagtcacctcatgtaatttctgtatgaatggccttttagctcattatgttcgtatttttttcctgtttgtttctaacttctctgtattacatataagggcattttctaaacttttcaccacatg

SEQ ID NO: 453306 - DNA, 4251 bp, Homo sapiens
acgccatacgccggggcggggccgagagtttggagccccggagtggggtgtcggcgcctcattcgggtggagctgagccggagacaggcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453307 - DNA, 10195 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453308 - DNA, 10756 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaaggtaaactttctgctaaaaattaatgaaccataaatacctatttgtgccttgaaaagctagtaccagtttttttttatttttgtttccagattacttagagtgaattgggtgaatcaagagctgtttagtcactagacgtagctatttcttgcattttactttctgttcacgggacattgtgctgagcataagaatattctagagcctgctcatcagctgttccttagcttcttgctgcagttagggggctgatccagctctagaagaatggaggaggtctgctattatgctgattcttattgctggagtgggcctctgtgactgatggccatatattggatcccttaggtggaaggaaatagagaaaagctgagaaccctggtctggaccagtgaaatgctttctaggggcttccatttgctaaaagttgaaaattgagttcccaatcttgagccgtgtttttcatggtgctattgttattattcattgtcatcaggttcctccactgtgtggtagataggtacttgcacagccggtatgactctgtttttttatctctagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453309 - DNA, 5537 bp, Homo sapiens
ggacgcgtgggtcgacccacgcgtcgcttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453310 - DNA, 4211 bp, Homo sapiens
  misc_feature (26)..(26): n is a, c, g, or t
  misc_feature (44)..(44): n is a, c, g, or t
taggctaggtacgaggcccggtgttnatcggcgagggagccggngacgcagttgtgaaaaacttcaggacaaaaatgtttcatttaaggacttgtgctgctaagttgaggccattgacggcttcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453311 - DNA, 8503 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453312 - DNA, 4183 bp, Homo sapiens
tatgtgtgttgatggaaggcggccacagggcatctgtgttatagctgtgggggtcagaaagtgcatcccgaagacaaaagttgtggaaagcagggagcctgaatgctgagagaaacccaccgtttgggaacagacagagaccccactgtccaggaggaagcaggctcagccagcctatggtagacttgccttgcctgcagagagcagttctctgtggccacagatgcatcctggacttaggggagcagtgaggtaaccctgtaccttctttgtctttagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcaggtcaggggtcaccacattgcaaaaccttgatcctctcggaattagttgtgtaaattttgatgatgctccagtaactgtttcttcaaacgtggggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453313 - DNA, 2635 bp, Homo sapiens
  misc_feature (4)..(4): n is a, c, g, or t
  misc_feature (9)..(9): n is a, c, g, or t
tgangatgntctagaggatccctcacgcccatgtcacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453314 - DNA, 9305 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtttgaggagttcctacagcggaagtggtcctctgagaagcgctttggtctagaaggctgcgaggtactgatccctgccctcaagaccatcattgacaagtctagtgagaatggcgtggactacgtgatcatgggcatgccacacagagggcggctgaacgtgcttgcaaatgtcatcaggaaggagctggaacagatcttctgtcaattcgattcaaagctggaggcagctgatgagggctccggagatgtgaagtaccacctgggcatgtatcaccgcaggatcaatcgtgtcaccgacaggaacattaccttgtccttggtggccaacccttcccaccttgaggccgctgaccccgtggtgatgggcaagaccaaagccgaacagttttactgtggcgacactgaagggaaaaaggtcatgtccatcctgttgcatggggatgctgcatttgctggccagggcattgtgtacgagaccttccacctcagcgacctgccatcctacacaactcatggcaccgtgcacgtggtcgtcaacaaccagatcggcttcaccaccgaccctcggatggcccgctcctccccctaccccactgacgtggcccgagtggtgaatgcccccattttccacgtgaactcagatgaccccgaggctgtcatgtacgtgtgcaaagtggcggccgagtggaggagcaccttccacaaggacgtggttgtcgatttggtgtgttaccggcgcaacggccacaacgagatggatgagcccatgttcacgcagccgctcatgtacaagcagatccgcaagcagaagcctgtgttacagaagtacgctgagctgctggtgtcgcagggtgtggtcaaccagcctgagtatgaggaggaaatttccaagtatgataagatctgtgaggaagcttttgccagatctaaagatgagaagatcttgcacattaagcactggctggactctccctggcctggcttcttcaccctggacgggcagcccaggagcatgtcctgcccctccacgggtctgacggaggatattctgacacacatcgggaatgtggctagttctgtgcctgtggaaaactttactattcatggagggctgagccggatcttgaagactcgtggggaaatggtgaagaaccggactgtggactgggctctagcggagtacatggcgtttggctcgctcctgaaggagggcatccacattcggctgagcggccaggacgtggagcggggcacattcagccaccgccaccatgtgctccatgaccagaatgtggacaagagaacctgcatccccatgaaccatctctggcccaatcaggccccctatactgtgtgcaacagctcactgtctgagtacggcgtgctgggctttgagctgggcttcgccatggccagtcctaatgccctggtcctctgggaagcccaatttggtgacttccacaacacggcccagtgtatcatcgaccagttcatctgcccgggacaagccaagtgggtgcggcagaatggcatcgtgttgctgctgccccatggcatggagggcatgggtccagaacattcctccgcccgcccagagcggttcttgcagatgtgcaacgatgacccagatgtcctgccagaccttaaagaagccaacttcgacatcaatcagctatatgactgcaattgggttgttgtcaactgctccactcctggcaacttcttccacgtgctacgacgccagatcctgctgccattccggaagccgttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgatgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453315 - DNA, 1640 bp, Homo sapiens
aaaataggctaagtagaggcgcgtggtaatcggccgaggcagatctgctgcattccggaaccttaattatcttcacccccaaatccctgttgcgccaccccgaggccagatccagctttgatgagatgcttccaggaacccacttccagcgggtgatcccagaagatggccctgcagctcagaacccagaaaatgtcaaaaggcttctcttctgcaccggcaaagtgtattatgacctcacccgggagcgcaaagcacgcgacatggtggggcaggtggccatcacaaggattgagcagctgtcgccattcccctttgacctcctgctgaaggaggtgcagaagtaccccaatgctgagctggcctggtgccaggaggagcacaagaaccaaggctactatgactacgtgaagccaagacttcggaccaccatcagccgcgccaagcccgtctggtatgccggccgggacccagcggctgctccagccaccggcaacaagaagacccacctgacggagctgcagcgcctcctggacacggccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453316 - DNA, 1141 bp, Homo sapiens
gtggagaagggttccatgtgaacagcagtggcccaagcaacccttcgacctggacgtcttcaagaacttctcgtagatgctgcctagggttgcttgggccactgccctctccacacccatgactgccccttgcttctcaactaaagaatagtgcctcagcgctgcccacaccaccgccctcctcgctgtgccaccacccctccctctgctctcataggagttaggctgtcgtccccctccagtgcttggctgccccacaggccacacgctgcccaggctctgctgacttctgagcagttttccaggaggccggggggagcaggaggaggaaaggtagcccccgagggatgtccttggggaggggtcagctctggccacaatcctccccaccagtctcacccactaggataggaactgggccttgtgtgctggcttccgctgtcacccagcaaggcacaggctcctgtatttgagactaggatagcttcatcttgagcctgagccttagaatctgtagaggagcctggagtcggatctagccatggctggcagaggtttctagggtgggccccagccgtggcgtgaactgaggatgacccggggcagctggcaggagagagccttggcctgacctggcacagaaagggcagcttcagtctctgcagtgtccattatctgctgttccttcgagggttccaggctgtgtgtggggcccaagcatgccccacccacccctcctgggcccaggcagcacctggagcccacagagtctgtgtgtagccaggaagccccgctcaggtagccaccgccggggcactggctgctctgtcttggtcctgttaaccctccacctcctctcttggactccctccccaccccaaccactctttctttctcctttaacccaatggagactttctgatgcatcgttttctttgctgtgccaaagcaggtcagaagagggagaggaggggctgggggtgaggggccaggccatggccaaggggccagctgcccctcatttatcactctgaccttcacagggacagatctgatttatttattttggttaaaaaaaaaaaaggaacagaaacaactttgcattgcattggcttgacccataaactaagttatatccgtg

SEQ ID NO: 453317 - DNA, 7120 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctaaactagaggccacggacaaatacaaagattgcttagtgggattaagattccaccattcccagactgttaagacattttcacaaaacagaccagcagcagctaggacatttcaacagattcggtgctattctgcacctgttgctgctgagccctttctcagtgggactagttcgaactatgtggaggagatgtactgtgcttggctggaaaaccccaaaagtgtacataagtcatgggacattttttttcgcaacacgaatgccggagccccaccgggcactgcctaccagagtccccttcccctgagccgaggctccctggctgctgtggcccatgcacagtccctggtagaagcacagcccaacgtggacaagctcgtggaggaccacctggcagtgcagtcgctcatcagggcatatcagatacgagggcaccatgtagcacagctggaccccctggggattttggatgctgatctggactcctccgtgcccgctgacattatctcatccacagacaaacttgggttctatggcctggatgagtctgacctcgacaaggtcttccacttgcccaccaccactttcatcgggggacaggaatcagcacttcctctgcgggagatcatccgtcggctggagatggcctactgccagcatattggggtggagttcatgttcatcaatgacctggagcagtgccagtggatccggcagaagtttgagacccctgggatcatgcagttcacaaatgaggagaaacggaccctgctggccaggcttgtgcggtccaccaggtatgggtctggccctgggccatggggcagacattcccagggaagcagtgaccctgtctgtgttgatcgggcctgtgtgcagcctgttggccgaggtgagagggggtttggggtggtacaggcaaagctccatctgcacatgtgtgaagagacaccagacaagtagagtcagccttcagagcaacctccgcctcctgaattcaagtgattctcttgcctcagcctcctgagtagcagggattacagaggcacaccaccacggctggctaatttt

SEQ ID NO: 453318 - DNA, 6262 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctctatgatttagaggccacggaggatcactttgtgaggcttgccaatgcattgcctttgtttttctgaccagatgcagataaggctactcgtattccaggaactgtttgtgatagaacagcaagtacccttcgctgtccaggacgtacttgatgctggccttggtgatgatggaatcgtcacacttgaaccactggtctatgtgctgccggataaa

SEQ ID NO: 453319 - DNA, 6279 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttggggctgatccagctctagaagaatggaggaggtctgctattatgctgattcttattgctggagtgggcctctgtgactgatggccatatattggatcccttaggtggaaggaaatagagaaaagctgagaaccctgattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaaaaaat

SEQ ID NO: 453320 - DNA, 5775 bp, Homo sapiens
  misc_feature (1880)..(1880): n is a, c, g, or t
cagaagggctctgttagtgcgcctctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggcnctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggacttgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttatagagacctgcctattattctttggcgccatcagagagagctgcagggatcctctaagcgc

SEQ ID NO: 453321 - DNA, 290 bp, Homo sapiens
ccgctcatgtacaagcagatccgcaagcagaagcctgtgttacagaagtacgctgagctgctggtgtcgcagggtgtggtcaaccagcctgagtatgaggtacgtccctgcggctctatcccagtgcgcctttccagggctggcgatgactagaaaaggtgggccacagggccagttctcacttttgccagttatgaggatacacgtgagaggatgtgaaatatttacaactacagcatttcaatgcataactttttggagaatctgggccactgagatgctttataaag

SEQ ID NO: 453322 - DNA, 2960 bp, Homo sapiens
ggctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgtta

SEQ ID NO: 453323 - DNA, 2516 bp, Homo sapiens
ggctgctgcactgacggcgggtgcccgcgcctcagagttactgatttattcttgagattcctctactctcgttatctgacctcatggatgaacttcaggatgttcagctcacagagatcaaaccacttctaaatgataaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagcaccttgggaggctgaggtgggaggatcatttgaggccaggagtttgagacctgcctgggcaacataatgaaacttcctttccagggag

SEQ ID NO: 453324 - DNA, 2720 bp, Homo sapiens
  misc_feature (2703)..(2706): n is a, c, g, or t
ggctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttaaaaaaaaacnnnnaaaaagggcggccg

SEQ ID NO: 453325 - DNA, 3279 bp, Homo sapiens
ggctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgttagttaaaaaaaaaaaaaaaaaaaaaaaaaaaaaaaaaaaaaacctccgggggcttcttattttttgggggggggaaaaaggagggtattggaagtgggccagtgggtcatatagtgtgttttcgtgacccagtttttttgtgtcaaaggggggaaaatattggggggccccccaattgaggggcggggtattaaattgggaaagcccggggttaccctgtgttagaacttttgggaagaagggaaatgagcagccgcatgaagcaaggaaggaaatctacacactgaacacacgccccacaaacacactcaagataacaagagaaaccaagtaacagagaaagagagaccgagacaacacgcaagaaaccagcagcggcggcgaacaacacaacgcacatgacagaaaaaagagtacgacaaacaagacacagcatcacgtaccatgcaaaacgcgacaaacaaaaagacgaaagagaaagtacaaacacgacgagcagcagagagagcaggcacagaaaaatgacgcagaacgacgccagacctaagagagcaacaacgagaggtaggagacaacccaaagcataa

SEQ ID NO: 453326 - DNA, 2032 bp, Homo sapiens
ggctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgtatacattcttattttagaactataaatatactaaatctttaccttacttcttttatttctttcctatttttaatatatacttattttttatatcacccttattactc

SEQ ID NO: 453327 - DNA, 513 bp, Homo sapiens
tagtctcgttgtatcgggcttgcactgtgtttgtgaaacaccttcatacttgtgtgtgtgtctttcttttcttttggtttagtcttgcatgcactgtaggttttggttacctgtttgggttcccaaagcctccattctgtcactgtctgaatggtgtgggcatagttaagaggctatactctggatttagggtttccccttgttctgcggtgactacaatcagctgagattccaaccagatctaaaggattaaagtggcctcacatatcgccactcacctagagcaaatgatacaaaatggggatggctatatcttgtcctgggtgtcatggtaaatgagtcggaaaagctaaacataaagactttgatgagactcctaggttagctgggcttaaccggggcttcatcttctagtccccttggttctctgttacagtaccatctgccagcatgactcggctcgcccgatcacgaacccactcaacctcgagtagcctcggctctggagaaagt

SEQ ID NO: 453328 - DNA, 2924 bp, Homo sapiens
ggctgctgcactgacggcgggtgcccgcgcctcagagttactgatttattcttgagattcctctactctcgttatctgacctcatggatgaacttcaggatgttcagctcacagagatcaaaccacttctaaatgataaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgtta

SEQ ID NO: 453329 - DNA, 2693 bp, Homo sapiens
ggctgctgcactgacggcgggtgcccgcgcctcagagttactgatttattcttgagattcctctactctcgttatctgacctcatggatgaacttcaggatgttcagctcacagagatcaaaccacttctaaatgataagaatggtacaagaaacttccaggactttgactgtcaggaacatgatatagaaacaactcatggtgtggtccacgtcactataagagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgtta

SEQ ID NO: 453330 - DNA, 3031 bp, Homo sapiens
aggctcattgtgtagtcacactctagaatgctggggtgggagatgagataactggatagagagcctgtaaaacagatgataattgactaagacaaaaaggtagcaacagcacgttactccctgcagtggcctgacaactgaatcagctccttagccagggtctctgcacattcatcttcagatggagtttttttcaagctgttcattcacaaggtcacgaaaaatatgcatgccaatcaccatggaggaacatgatatagaaacaactcatggtgtggtccacgtcactataagaggcttacccaaaggaaacagaccagttatactaacatatcatgacattggcctcaaccataaatcctgtttcaatgcattctttaactttgaggatatgcaagagatcacccagcactttgctgtctgtcatgtggatgccccaggccagcaggaaggtgcaccctctttcccaacagggtatcagtaccccacaatggatgagctggctgaaatgctgcctcctgttcttacccacctaagcctgaaaagcatcattggaattggagttggagctggagcttacatcctcagcagatttgcactcaaccatccagagcttgtggaaggccttgtgctcattaatgttgacccttgcgctaaaggctggattgactgggcagcttccaaactctctggcctgacaaccaatgttgtggacattattttggctcatcactttgggcaggaagagttacaggccaacctggacctgatccaaacctacagaatgcatattgcccaagacatcaaccaagacaacctgcagctcttcttgaattcctacaatggacgcagagacctggagatcgaaagacccatactgggccaaaatgataacaaatcaaaaacattaaagtgttctactttactggtggtaggggacaattcgcctgcagttgaggctgtggtcgaatgcaattcccgcctgaaccctataaatacaactttgctaaagatggcggactgtgggggactgccccaggtagttcagcctgggaagctcaccgaggccttcaagtactttttgcagggaatgggctacataccatctgccagcatgactcggctcgcccgatcacgaacccactcaacctcgagtagcctcggctctggagaaagtcccttcagccggtctgtcaccagcaatcagtcagatggaactcaagaatcctgtgagtcccctgatgtcctggacagacaccagaccatggaggtgtcctgctaagcagatgctcctcccctggaccattgcaagtccatccttcaaatgaccactccataatataacatttcatccagtaaactggcctctactatctttaactcatgcatggccactgaacctctctctagtagcctggatttatcattctctctgcctgcccacccccttttttgtatagcccaagaaccacttccatgccatactgtaacattccaacatctttagctgatcagatctctccatatcctctcttgccagctttttcccgtgctcccccaactatgtatcagataagattctttgatcccgactctgtgtgtgcgagcacgcgtgtctgtgtttgtgtgtgcatagttctgtggttttagacacgctttcttgtagtgcttctgcaaaaaacaaaaaagggacttattttgcattctcaatggtgtttttaagggaattaggcagaacagatttctaggttgggtaggccactgcattctcttttgtttgcaaattggtcaacaaaatttgcaaagtgatttcaggagagagcagctttgaggaatgtggaaaatcataattgccgtctggaccattgattgattgtgaccagtagcagaagggtgcctgttacatagagaggctccttctgtccaaatgaatttctgtatactcttctataaataaaagggaggaatatattctgctggaagcccatgaaccatcgctgaggttctgatacaacatagagttttttccaaggagtgaatgtggtttaattactggactctcttagcacaggaaggtggaaacaaaatgccaggcctctgctctgaagagcaaaactgctgtcgctgcagtatctgataccagacatccacatatccacaagaagtgcctcttaggtctgtgacagagagtgtgtctccattcctcagttcccagaaaggggagaggtttggcctaaaaagcatgtagatgggggagaaatgggtggggggagaggaacagccattaacacagtatcatgtttaacaagtatagccttgatttcagtagatgtaatggaagccaaattaaattgatacagaacccatttctcagagtctttttttttttttgagacagagtctcgctgttacccaggctggagtgcaatggcgcaaacttggctcactgcaacctctgccccctgggttcaagcgattctcctgcctcagcctcccgagtagctgagactacaggcacctgccaccatacccagctaagttatgtatttttagtagagatggagtttcaccatgttggccaggctggtctcaaactcctgacctcaggtgatccacctgcctcagcctcccaaagtgctgggattacaggcatgagtcattgctcccagccattagaaagattgttaatcctatgaactcccttttgtaggagagaaagggccaatctgtaggggtagccctgtccaggtaaagttgttttcagcctcatgtctactgttaggtgagggagtcacagccagacagagagtattgctggagggtgagagaattgtggagaccaactaccacatagcaagagcccagctcttgggagcattgagatgtaagctcagggttacacagttccaaatcttgggaaggggcttttcagacagactgtttgctttctgctgagataaggaatgcatcactctgccagagtatgactttttacagattattaaataaagctgcatatgtctcattgtta

SEQ ID NO: 453331 - DNA, 857 bp, Homo sapiens
  misc_feature (857)..(857): n is a, c, g, or t
caattattccaaatctattccactctcttcaagcctgtaccccacctgccctttctcagcaggctgctcctctcacttctaggagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatcaacagtggcaagatagacgtgaaaacgccttttgtggttgagatcgctgattggtgacacaactggcacacacacacacacacgcacatgcacacacgcacgcatgcaccn

SEQ ID NO: 453332 - DNA, 1643 bp, Homo sapiens
caattattccaaatctattccactctcttcaagcctgtaccccacctgccctttctcagcaggctgctcctctcacttctaggagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctttatattaaatacttttagatcaactctttttgcaagactttttaaaaatgtaaagttctttaagaaatatacaaaaatacacacactctagcattaacagtgaacagattagaaagattttataaatcaaactacaaacataattagataactcagaaattatgcccatccacatctcatatacttaaggtgattatttacttattgttattcaatgtaacatttttagaaagttatctttagcccagttgcaataggaatattttttgttacttacataaggggattaagactcaggctataaggcctgggtatggtggctcatgcctataatcccagcactttgggaggctgagacaagagaatt

SEQ ID NO: 453333 - DNA, 1635 bp, Homo sapiens
caattattccaaatctattccactctcttcaagcctgtaccccacctgccctttctcagcaggctgctcctctcacttctaggagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattgggccaaaaaaaaaaaaaaaaaaaaaaaaaaaacaaaaaaaaaaaaaaaaaaaaaaaaaaaaaaaaaagggcggcggcgcgcgcccccaaaagaaaatacacccccgcgagggaggcgccccacactcaccgcgccgcaccccccagtttttctgttgcaacaaaggcggcgcccccaaataaggcgggcaggcgcattaatacaaacaagagcgagcggggcgccgcgacaaaaaaccacagcggccgcggagcagggggaaaaaaaggggtgacgacacgcgggagaacactcctggggagaagaagaaccccactccttctcgggggcgtggtgcccatattgtcgggaccaagctaaccccccagagagagagagaattaaagcgacccagaggtggaaaacatctgacacacttacacaggttggattcacagggttgtcaaccacacgatgcagcgaatattgctgagccgcgagacaaaagtggctgaccaaccaggacaaagctgaataagaaacaattattataacaagggacatgactaggcaacacgag

SEQ ID NO: 453334 - DNA, 1995 bp, Homo sapiens
ctatgatggccagccaccgctgagagcacgaagctgctgctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttggggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattccaaaacttgaaatgcaggacgccattaagtgtctgtttatatttttggaatatttgtattacttacaattaattaataaaagtgggtttaaaaaacc

SEQ ID NO: 453335 - DNA, 3215 bp, Homo sapiens
gataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgctctaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtggtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttggggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattccaaaacttgaaatgcaggacgccattaagtgtctgtttatatttttggaatatttgtattacttacaattaattaataaaagtgggtttaaaaaacc

SEQ ID NO: 453336 - DNA, 3161 bp, Homo sapiens
gataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgctctaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctggggtgggtggggttctctcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttggggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattccaaaacttgaaatgcaggacgccattaagtgtctgtttatatttttggaatatttgtattacttacaattaattaataaaagtgggtttaaaaaacc

SEQ ID NO: 453337 - DNA, 3189 bp, Homo sapiens
gataaaggaagggtatgcctttgggtactccaggcacacacctttctgaaatccttctccagccagctgctgcagacaaaagatcacatttctgggaagatgagaacttgtttccagaccagcatccagtggccatcaggtcttgtggcccaaaggctatgcttgcctccggctgagtgcctgggataggccttttctatgtctccccaaggctggggtgctgagcctgctctaccacctagccatagtctcaaacctgtggggaaggaggttttctccctgcccgggaagaggacagataactgatttccgttcttttgactgtgttttaaaattctctttctaaacacagagtgttgggcctggtttgtttctgacaaagttacagtcctgggcctgtaatgaatgtcggcggcgctggggttgcagggaaaagacaaatcctcaaagcgtggacgtgtgtccccatggcttgtggatcagctaagctcgggatcatttccataagtctgcttttcagggattctctgctggtgctggtgcaaggacttctgttccaaaggctgggaaaaactaagctgtcccagcccctcccatttcttgggcagggctcttttcctgttgtgtcttcccccagggcctgtcctgtaccgagctctgtctgttccagccttcatccttcctggctgttgcttttcctcttaagggcctcagaactcttgctcttcctgggctgagggggaatgagtgttcttgccatttgccagcctaatgcgcatgctttctgcctctggtaacaggagtgagtgagcccctcagacctgcactctgggtgtctcctgctttcaaaggttcttaatagtgaatgctttaaaattaaagtcatcacgaaatggaagttttcccagggtggaaaataagaggaagtgctgctgtaattgggagcacaaggggcctcccaaaaaggagccccacctcagcatcactgccttaatcgtggcctccctccctccctcctcctggggtgggagggcgctcctgttcccatctctgtgttccctggaggcaggtatcacaaagcatttgtgaattgctttaggtgcagggacaccacccactcaggactcttccccatcatcccttccattgccacaccctagatccagcctcaggaactaacaagttttgagaaaagcaggtggtagagcagcagcttcgtgctctcagcggtggctggctggcatttttctctagcgttgtggtgccaccttcccttcttgtcccaaggttataaggccttgtctttctctttggaatcataaagtggaacagagtccccagaactcatgtggccatttccgccagcatcactccccggtgcctatggggtcccggtgtacctaaagggagaaggaccccatgtgctagccagaaatatactgtctcttgaaggaaagcaggagctcagactcttagagccagctgtggcttcggacccaaggcctgacctaggctgctatcctaatattgcaggaggggcctctcttccaagccccaccctaagggttagcccttggccaaatcttttgccgtctaggcccagccaggcttttctgactaaataagcaataagaggctctaagctgactgagttgcaaggaccctttccgccctcccttggatctccatgtttttccagatggcggaagagcatgtgccaccccctttcctaacagacttgtccaagtgcttggcgtgggacccatgaccaaagcccaggatggcttggtgggagtgtccctgctgcatctgcatgaagcccctgctttttaggcctcactcccatcagaaccctgcctgcccacctgcaactcccccccaacaatgccattcccacttgccccagagaagctactcggccaaacctagccagggtctgttcttgtggaccagagccagcctagtcattatttgctgtcgggtttccagtttcaccgtgtgttagggtgagggatgattgtaaaatttgctcctcaaaggaatcaggccagactcaattttggagggcaagacagggaggaggccgcttcatcccagactctcttctagggcttcccaccatcagcccctcccacttgagactggtctttgggaggcaataggccaccatgcctggtcagcaccaattcaagccatgccaggaatctgcctacctgccaggttcagttcttttaaggtgcctcttcagggacacagtgtgtctctctgattgggcttctaaatcaaaagcctgatgttcgtgtccctctcatagggggagctttggacacaggaccagtttggaaaagggtcaggtaagggtttccactctgcacattgtagagggaacactctgtaggcccatgggtcccttactagagaggttgagtgaatttgccttcagttaacatgggaccttctgtttagcttcctcttgcttcccaaagattttaagcattttgtaaatgtataaactcacctctggtaacagtggcccagacgctgctttgtgctaaaagcatgggaaatgtaaaggcagtctttctctgggaaatggatgctattctattctgctgcccctacctgttcctgaggcctcatttagaaagaaaatcccctcagaaggctgtctggcacccagtgtcctagccaggccaagtatatgagaaaggtaagtccattttccccttcaggtcctcagtggattacttaaccactgctgtccctcggtccctttttcctaaacgggtttagttctgtcttttttctccttttttctaaatgctggtaaatatttacattcagccagggaagaggaggccagaggtcgggccagctgccccattcttttaacgttgtagggcctgcccatggagcggaccctcctctttggggcctcgtgagcttttttgcttatcatgttccatttcgtgccgctttcccccttcaagatgccatttggagggtaggggatctgcttcccactgtgactgggctatgggattctgactaccttgcttacagattcatggtttgataaatttgttgtattccaaaacttgaaatgcaggacgccattaagtgtctgtttatatttttggaatatttgtattacttacaattaattaataaaagtgggtttaaaaaacc

SEQ ID NO: 453338 - DNA, 1933 bp, Homo sapiens
cttgcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtga

SEQ ID NO: 453339 - DNA, 757 bp, Homo sapiens
tgctggggttacaggagtgagccactacacctgtctgtaaaccaggctttccaacacacttttgactgagtctaggagcctgctagctcccatgtaatggcgcctaatccctacgacaaaaatattctcagtgatttggtttcacatacaggaagaggcaacattaagtacccaagggagctttaactaaccaacctttccttcccaaacaatgctagcccacaagtggaatagagtggtttctggacacctgaactcggccattctctgcctgtgattgtttctgggcttaagccaagctgggttatgtgccctctctgccctcctttctttctcccctggggaaaaaaaaaaaaaactggtctttgagtcagagtcctgaaactgataacccttccctagccataggtcacatccatgctgggcttctggttacctcacaagcagccacacatcctttctgctttgagctggtcagaatcatctctggggcctaggaccagaggaaggagaggaacagtgccccagggaccaaagatggatcacatcacccacagggctgatgtctcagtggcgatccagcaatccagaacttactttctgtctcttttctcctcaggaggtgataattgtcctggaaaggtaaggaggagttttctttgttagaagaggggccagcagaaagcatatatgcctatgacaaaggtgattgaattagaagtacatgcactgaagttttccccatctggcttcctat

SEQ ID NO: 453340 - DNA, 1889 bp, Homo sapiens
agcgcactgaggactctcagacaccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtga

SEQ ID NO: 453341 - DNA, 589 bp, Homo sapiens
cttgcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtga

SEQ ID NO: 453342 - DNA, 1701 bp, Homo sapiens
tgctggggttacaggagtgagccactacacctgtctgtaaaccaggctttccaacacacttttgactgagtctaggagcctgctagctcccatgtaatggcgcctaatccctacgacaaaaatattctcagtgatttggtttcacatacaggaagaggcaacattaagtacccaagggagctttaactaaccaacctttccttcccaaacaatgctagcccacaagtggaatagagtggtttctggacacctgaactcggccattctctgcctgtgattgtttctgggcttaagccaagctgggttatgtgccctctctgccctcctttctttctcccctggggaaaaaaaaaaaaaactggtctttgagtcagagtcctgaaactgataacccttccctagccataggtcacatccatgctgggcttctggttacctcacaagcagccacacatcctttctgctttgagctggtcagaatcatctctggggcctaggaccagaggaaggagaggaacagtgccccagggaccaaagatggatcacatcacccacagggctgatgtctcagtggcgatccagcaatccagaacttactttctgtctcttttctcctcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtga

SEQ ID NO: 453343 - DNA, 6614 bp, Homo sapiens
ctggtttatcaacttgacgagaatcatttcaaaattttaggaaaaaaatttatgtctcagtaaaactttgtttagaattaggtttttcagtagcaaggataaggtgaagggattaaaaatgtacgtaaaattagtagtcaatgaattctggaatgcagtctgtataatcctattcagagattatgctatttactgaatatagctttggttgtgtttaaatctgcactagtattaggtgctccttaaaagttgaaaatatatagccaataaggtataaagaagaattgacagataaatctaaacagtttctttgtatagtactaacttctgaaatgttcagtggtggcatttgataaagtaagttgtaatatgatcacattgaggaatgttatataattattaaactcaatttttataaaaggcatcattttataaaagtatcataagaaagtgccaatgtttcaatgaataaattgaggcaacatgataccaacttagtgaaaaatatacaagaccagaaggaagtaacctaaaatattactagtgattgcctctgggtaataggatatgggctttttgtctttctatatttttcattttcccactgccgtgttcctggtacctcagtgaaatgaagtgctcagttcttttaacagttgtcagtttttaaaacaaatatagtcttctggaaatgttttaggtagcattttcaattttatgtttttaagccatctcttgaatttgaataaattatttgaactgcataaatatttgcaatccattgagaacaccaaaacaaaaagtaaaaagcagaaacctaaatttttctaaattttttttaatatctagaagttgtatctcaaagtttttgtaattttcttcattgtcagattttattttttactgtcaaatatccaatgacagaggccacctcttttaaaatagaaactttaaatggaaatatacattatactaagtcttatattttatagccttgaaagtttctattcatgtaattaagctttttctgatttttagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453344 - DNA, 4851 bp, Homo sapiens
aaaaaaaaaaaaaaaaaaaacataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453345 - DNA, 6274 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453346 - DNA, 3672 bp, Homo sapiens
taggctaggtacgaggcccggggttaatcggccgagggaacgatgcaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453347 - DNA, 3219 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaaggtatttttatatgtgtgttaatgttttgtttgggaatatgagagcagaattgtctcactgtatggataaatggatccatctaaaacaaggattggcatactgtggcctgtgggccaaatccagcctcctttttgtttttgtactgcctgctaactaagaatgttttttatgtttttaaatgattggggggaaaaactag

SEQ ID NO: 453348 - DNA, 503 bp, Homo sapiens
ttttcagacctttcacatgtgctacctaaatggagattacaaaactgtttatcccaaggaactttgttctgcataaggaataacctctatgcttattatcatattttttaaggagccagacttttctgaagatcaagaagaaaagaaaaaagattcaaaaaaatccaaagcaaacttgcttgaaaggaggtcaacaagaacaaggaaatgtataagctacaggtatgaagtgtatggaaatgtctacagcaaaagaggatttattttgcaagtacacagcatgatccagaagtatatgctttttctatcatgctgattattgcagttgtatatatatttcttgccttccatctttagtcatagaattttttttttcctttttcttttttttttgagactgagtctcgctcttgttggccaggctggtctcgaatgcctgacctctggtgatttgccctcctcagcctcccaaagtgctgggattacagccatgagccaccgcg

SEQ ID NO: 453349 - DNA, 788 bp, Homo sapiens
cctttaaaacatcttgggatcttttttaaaaagtataatcactgttacatacacatgttgaaccaaatgctgttttaaacattgactattgccagtaggataggcacagaatccgtttcttttggcaaagctgtatgtttctttaacgtgtgctttatttcaaaggtactgtgctcatcttctgttcaaaaggtgtgtttaattaaacacaagaaaagcttcattgttcacttactatgtggtcccttaccagctctcagagcccactacccatgaagttaacatgtatgtaataaatgattgctaaaagttgtttaaaatgacttttatctattttgcttcttcagaaactgctctgtgaaaaattagaggaacagttgcaggatttggatgttgccttaaagaagaaagagcgtgccgaacgaaggtatttttatatgtgtgttaatgttttgtttgggaatatgagagcagaattgtctcactgtatggataaatggatccatctaaaacaaggattggcatactgtggcctgtgggccaaatccagcctcctttttgtttttgtactgcctgctaactaagaatgttttttatgtttttaaatgattggggggaaaaactagaatcatatttcatgacacatgaaaattatatgatactcaaattttattgtctgtgaataaagttttattgaacgcaaccttgctcatttgtttgtatattgtctgtggctacttttgccctgtgacagcagcattgagtagttggaacagagaccttatgac

SEQ ID NO: 453350 - DNA, 985 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagcagcaaacaatggctacaaacttcctagcacatgagaagatctggttcgacaagttcaaatatgacgacgcacgaaaggagattctacgagcagatgaacgggcctgtggcaaggtgcctcccgccaggagaacggcgccagcgtgatcctccgtgacattgggaagagccagaagagaacatccagaaatcctggctggaagctcaggccccggggctcagggggcaccagcgggagaccacgggtgagctcggcgtccggatggcaggctggaagtggagaaccc

SEQ ID NO: 453351 - DNA, 6429 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453352 - DNA, 6336 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453353 - DNA, 3238 bp, Homo sapiens
aaagggaagcttttaataaacacatatttttctctccccgaacttccctcccccaaattcaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtgtgtgttggaatttcctatctgcctggatatattagcagagtttgaatgtagttttggcctttggccattaagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaataaaaag

SEQ ID NO: 453354 - DNA, 2982 bp, Homo sapiens
gatccgcagaggagcccacttgagagcgcctcctgtcgtctgtaaggttgccttgccatccctcggcaccccaacttcccccgcccccccatcgcctcctcctccatcctccagttcaaaatggcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctatctaccaaatgctgcatatggattttcatttaatcctcatagcaactctttgagaggaacagaaagaaagtgaaaagatgaaaagtgaggagcagcctatggatttagaaaaccgttctacagccaatgttctagaagagactactg

SEQ ID NO: 453355 - DNA, 183 bp, Homo sapiens
ggggcagtcactcagggggcatttgactcacaccagttagtttcctgcctctgccttgacccgaaggtcttacaggaactgtgtgtgtcctacacaatggtgctattctgtgtcaaacacctctgtattttttaaaacatcaattgatattaaaaatgaaaagattattggaaagtaaaaaaa

SEQ ID NO: 453356 - DNA, 3092 bp, Homo sapiens
agcggagtggtgcaggaagacgcctgtgctgcccacactgctgacctcccctgggccctactagctgtggctctcagggtctctggaacactggctcagctcaccttttcttttccactgcagggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaaaaa

SEQ ID NO: 453357 - DNA, 4068 bp, Homo sapiens
  misc_feature (1012)..(1012): n is a, c, g, or t
  misc_feature (1264)..(1264): n is a, c, g, or t
acgcagagcgctgctgggctgccgggtctcccgcttcctcctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagtcgctggtgctgctgacgctgctcgtcgccgctgtccttcggtgtcagggccaggatgtccggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggtgaaaggggtccgcctggtcctcagggtgctcgtggtttcccaggaaccccaggccttcctggtgtcaaaggtcacagaggttatccaggcctggacggtgctaagggagaggcgggtgctcctggtgtgaagggtgagagtggttccccgggtgagaacggatctccgggcccaatgggtcctcgtggcctgcctggtgaaagaggacggactggccctgctggcgctgcgggtgcccgaggcaacgatggtcagccaggccccgcaggncctccgggtcctgtcggtcctgctggtggtcctggcttccctggtgctcctggagccaagggtgaagccggccccactggtgcccgtggtcctgaaggtgctcaaggtcctcgcggtgaacctggtactcctgggtcccctgggcctgctggtgcctccggtaaccctggaacagatggaattcctggagccaaaggatctgctggtgctcctggcattgctggtgctcctggcttccctgggccacggggncctcctggccctcaaggtgcaactggtcctctgggcccgaaaggtcagacgggtgaacctggtattgctggcttcaaaggtgaacaaggccccaagggagaacctggccctgctggcccccagggagcccctggacccgctggtgaagaaggcaagagaggtgcccgtggagagcctggtggcgttgggcccatcggtccccctggagaaagaggtgctcccggcaaccgcggtttcccaggtcaagatggtctggcaggtcccaagggagcccctggagagcgagggcccagtggtcttgctggccccaagggagccaacggtgaccctggccgtcctggagaacctggccttcctggagcccggggtctcactggccgccctggtgatgctggtcctcaaggcaaagttggcccttctggagcccctggtgaagatggtcgtcctggacctccaggtcctcagggggctcgtgggcagcctggtgtcatgggtttccctggccccaaaggtgccaacggtgagcctggcaaagctggtgagaagggactgcctggtgctcctggtctgaggggtcttcctggcaaagatggtgagacaggtgctgcaggaccccctggccctgctggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctattgggatgacattttgggtccacacctgccacggtc

SEQ ID NO: 453358 - DNA, 4016 bp, Homo sapiens
  misc_feature (1012)..(1012): n is a, c, g, or t
  misc_feature (1264)..(1264): n is a, c, g, or t
acgcagagcgctgctgggctgccgggtctcccgcttcctcctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagtcgctggtgctgctgacgctgctcgtcgccgctgtccttcggtgtcagggccaggatgtccggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggtgaaaggggtccgcctggtcctcagggtgctcgtggtttcccaggaaccccaggccttcctggtgtcaaaggtcacagaggttatccaggcctggacggtgctaagggagaggcgggtgctcctggtgtgaagggtgagagtggttccccgggtgagaacggatctccgggcccaatgggtcctcgtggcctgcctggtgaaagaggacggactggccctgctggcgctgcgggtgcccgaggcaacgatggtcagccaggccccgcaggncctccgggtcctgtcggtcctgctggtggtcctggcttccctggtgctcctggagccaagggtgaagccggccccactggtgcccgtggtcctgaaggtgctcaaggtcctcgcggtgaacctggtactcctgggtcccctgggcctgctggtgcctccggtaaccctggaacagatggaattcctggagccaaaggatctgctggtgctcctggcattgctggtgctcctggcttccctgggccacggggncctcctggccctcaaggtgcaactggtcctctgggcccgaaaggtcagacgggtgaacctggtattgctggcttcaaaggtgaacaaggccccaagggagaacctggccctgctggcccccagggagcccctggacccgctggtgaagaaggcaagagaggtgcccgtggagagcctggtggcgttgggcccatcggtccccctggagaaagaggtgctcccggcaaccgcggtttcccaggtcaagatggtctggcaggtcccaagggagcccctggagagcgagggcccagtggtcttgctggccccaagggagccaacggtgaccctggccgtcctggagaacctggccttcctggagcccggggtctcactggccgccctggtgatgctggtcctcaaggcaaagttggcccttctggagcccctggtgaagatggtcgtcctggacctccaggtcctcagggggctcgtgggcagcctggtgtcatgggtttccctggccccaaaggtgccaacggtgagcctggcaaagctggtgagaagggactgcctggtgctcctggtctgaggggtcttcctggcaaagatggtgagacaggtgctgcaggaccccctggccctgctggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagagagatgacatttgggttcccaacactggccggtccg

SEQ ID NO: 453359 - DNA, 491 bp, Homo sapiens
tgcccagatggctggaggatttgatgaaaaggctggtggcgcccagttgggagtaatgcaaggaccaatggtaagaaaagacactagttctttgcagccaaaatggcaggaggtggcccttagcagagccagagagtctgacaacctctgctttacagataattgcttagagtggctctcctccgtagttatgtaacctcccattcagctagcccaaagcatttggtttttaatggcaatggatgccacttttaatgatgcgctggagtgactaagaagaatgaagatggggagatgcatataggctgatctgttagaagaccagttgctattgctcttggaatgagaactgaagaatgcagacagcagctactgttctccagcatccacagacttccagcaggaaatctcagcccgcagctctgacttggcacatgctaaatgaaactcagcctttagtaaacatggctgctgtccaggagaaagcaagg

SEQ ID NO: 453360 - DNA, 4860 bp, Homo sapiens
  misc_feature (1012)..(1012): n is a, c, g, or t
  misc_feature (1264)..(1264): n is a, c, g, or t
acgcagagcgctgctgggctgccgggtctcccgcttcctcctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagtcgctggtgctgctgacgctgctcgtcgccgctgtccttcggtgtcagggccaggatgtccggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggtgaaaggggtccgcctggtcctcagggtgctcgtggtttcccaggaaccccaggccttcctggtgtcaaaggtcacagaggttatccaggcctggacggtgctaagggagaggcgggtgctcctggtgtgaagggtgagagtggttccccgggtgagaacggatctccgggcccaatgggtcctcgtggcctgcctggtgaaagaggacggactggccctgctggcgctgcgggtgcccgaggcaacgatggtcagccaggccccgcaggncctccgggtcctgtcggtcctgctggtggtcctggcttccctggtgctcctggagccaagggtgaagccggccccactggtgcccgtggtcctgaaggtgctcaaggtcctcgcggtgaacctggtactcctgggtcccctgggcctgctggtgcctccggtaaccctggaacagatggaattcctggagccaaaggatctgctggtgctcctggcattgctggtgctcctggcttccctgggccacggggncctcctggccctcaaggtgcaactggtcctctgggcccgaaaggtcagacgggtgaacctggtattgctggcttcaaaggtgaacaaggccccaagggagaacctggccctgctggcccccagggagcccctggacccgctggtgaagaaggcaagagaggtgcccgtggagagcctggtggcgttgggcccatcggtccccctggagaaagaggtgctcccggcaaccgcggtttcccaggtcaagatggtctggcaggtcccaagggagcccctggagagcgagggcccagtggtcttgctggccccaagggagccaacggtgaccctggccgtcctggagaacctggccttcctggagcccggggtctcactggccgccctggtgatgctggtcctcaaggcaaagttggcccttctggagcccctggtgaagatggtcgtcctggacctccaggtcctcagggggctcgtgggcagcctggtgtcatgggtttccctggccccaaaggtgccaacggtgagcctggcaaagctggtgagaagggactgcctggtgctcctggtctgaggggtcttcctggcaaagatggtgagacaggtgctgcaggaccccctggccctgctggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggagcccgaggtgcccaaggccccccgggagccactggattccctggagctgctggccgcgttggacccccaggctccaatggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaaaaa

SEQ ID NO: 453361 - DNA, 3014 bp, Homo sapiens
agcggagtggtgcaggaagacgcctgtgctgcccacactgctgacctcccctgggccctactagctgtggctctcagggtctctggaacactggctcagctcaccttttcttttccactgcagggacctgctggtgaacgaggcgagcagggtgctcctgggccatctgggttccagggacttcctggccctcctggtcccccaggtgaaggtggaaaaccaggtgaccagggtgttcccggtgaagctggagcccctggcctcgtgggtcccaggggtgaacgaggtttcccaggtgaacgtggctctcccggtgcccagggcctccagggtccccgtggcctccccggcactcctggcactgatggtcccaaaggtgcatctggcccagcaggcccccctggggctcagggccctccaggtcttcagggaatgcctggcgagaggggagcagctggtatcgctgggcccaaaggcgacaggggtgacgttggtgagaaaggccctgagggagcccctggaaaggatggtggacgaggcctgacaggtcccattggcccccctggcccagctggtgctaatggcgagaagggagaagttggacctcctggtcctgcaggaagtgctggtgctcgtggcgctccgggtgaacgtggagagactgggccccccggaccagcgggatttgctgggcctcctggtgctgatggccagcctggggccaagggtgagcaaggagaggccggccagaaaggcgatgctggtgcccctggtcctcagggcccctctggagcacctgggcctcagggtcctactggagtgactggtcctaaaggaggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctggtgccgaaggtccaccaggtccccagggtctggctggtcagagaggcatcgtcggtctgcctgggcaacgtggtgagagaggattccctggcttgcctggcccgtcgggtgagcccggcaagcagggtgctcctggagcatctggagacagaggtcctcctggccccgtgggtcctcctggcctgacgggtcctgcaggtgaacctggacgagagggaagccccggtgctgatggcccccctggcagagatggcgctgctggagtcaagggtgatcgtggtgagactggtgctgtgggagctcctggagcccctgggccccctggctcccctggccccgctggtccaactggcaagcaaggagacagaggagaagctggtgcacaaggccccatgggaccctcaggaccagctggagcccggggaatccagggtcctcaaggccccagaggtgacaaaggagaggctggagagcctggcgagagaggcctgaagggacaccgtggcttcactggtctgcagggtctgcccggccctcctggtccttctggagaccaaggtgcttctggtcctgctggtccttctggccctagaggtcctcctggccccgtcggtccctctggcaaagatggtgctaatggaatccctggccccattgggcctcctggtccccgtggacgatcaggcgaaaccggccctgctggtcctcctggaaatcctggaccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacgaaacataccggtaagtggggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaaaaa

SEQ ID NO: 453362 - DNA, 1023 bp, Homo sapiens
acgcagagcgctgctgggctgccgggtctcccgcttcctcctcctgctccaagggcctcctgcatgagggcgcggtagagacccggacccgcgccgtgctcctgccgtttcgctgcgctccgcccgggcccggctcagccaggccccgcggtgagccatgattcgcctcggggctccccagtcgctggtgctgctgacgctgctcgtcgccgctgtccttcggtgtcagggccaggatgtccggcaaccaggaccaaagggacagaaaggagaacctggagacatcaaggatattgtaggacccaaaggacctcctgggcctcagggacctgcaggggaacaaggacccagaggggatcgtggtgacaaaggtgaaaaaggtgcccctggacctcgtggcagagatggagaacctgggacccctggaaatcctggcccccctggtcctcccggcccccctggtccccctggtcttggtggaaactttgctgcccagatggctggaggatttgatgaaaaggctggtggcgcccagttgggagtaatgcaaggaccaatgggccccatgggacctcgaggacctccaggccctgcaggtgctcctgggcctcaaggatttcaaggcaatcctggtgaacctggtgaacctggtgtctctggtcccatgggtccccgtggtcctcctggtccccctggaaagcctggtgatgatggtgaagctggaaaacctggaaaagctggaccaggtcagggcctacagctgtgttgtccagtacaggagccacgagccaaatgtggcatttgaatttgaattaacttagaaattcatttcctcacctgtagtggccacctctatattgaggtgctcaataagcaaaagtggtcggtggctgctgtattggacagcacagaaaaagatttccatcaccacagaaaggtcggctggcagcactggccaaggtgatggggtgtgctacacagtgtatgtcactgtgtagtggatggagtttactgtttgtggaa

SEQ ID NO: 453363 - DNA, 1201 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctcctgttcttggcctgaagcctcacagctttgatggcagtgcctcatcttcaacttttgtgcttccctttacctaaactgtcctgcctcccgtgcatctgtactccccttgtgccacacattacattattaaatgtttctcaaacatggagttaaaa

SEQ ID NO: 453364 - DNA, 585 bp, Homo sapiens
ggaagagccactaaggctaatgcaattacgctggatcctgtgacagacacctcatgcttcatgggtcacatggtctgtttctgttcctctctgccctggttggtgtgggttgtggtgttagagaaatctcaggtgggagatctggggctgggacattgtgttagaagacagatttgcttccatatcttttaagtgtatatcttttcctctttttcccaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453365 - DNA, 568 bp, Homo sapiens
agtaatagcaaagacattggatccaaatttctgatcaggcaatttacaccagaactcctcctctccacttagaaaaggcctgtgctctgcaggagtattgactcatggagacttcagaacttgtttttcttcttcctgcagtgctctcatctgagtccttgaaagagggcaaaataaactgttagtagagccaggtctgaaaacaacactttcttgcgtctctgcaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctcaaacatggagttaaaaa

SEQ ID NO: 453366 - DNA, 257 bp, Homo sapiens
ccggcaggttgtactccaccggcggttgtactccaccaggcaggttgtactccaccggcaggttgtactccagaatggagactggaccttccagaccctggtgatgctggaaacagttcctcggagtggagaggtttacacctgccaagtggagcacccaagcctgacgagccctctcacagtggaatggaagcacggtctgaaagtccagtatccattctggagtacaacctgccgtggggaatcctcgagagcgc

SEQ ID NO: 453367 - DNA, 1206 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453368 - DNA, 1935 bp, Homo sapiens
gaggggggccatagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaacgtaagtgcacattgtgactgcagagctactatggggtgggggcaaaaataggaagttttgttaacattgtgcccaggctatgtctcttatgaaattgtgacactttcttcagagattgcccatctttatcagatggatcccaaattatttccaccacaaaaggcgcttggctacttgtcctgtccatgagatttgtgtaaagggcctacacacaggtcatttcttctcaaatctccaccaataaaacctatgcatcacatgtcctcagggtctttagaggatttagaaataagtatgctaaaataatttccccatacagcacttccctttattatgttgacttatgtcagacaaaaggaggtttttactgaaaattttgtgggagtcaagggaattcaaagggtctctcctagacgatccagtgttatgtcctccacaggacctttggtgttggcccctcttcctcatatgtgaggatggatccagtggcctccccattatctcctttcttttctttctgaactccaatgtttataaagcctgtacccctgttgcctatgtaggttctctgacaaaagttatacttagtgctctttctttcttatggggaaaaatccgtggaactgaagctgagatctttagtacgtggagtcaccttacagatatagagcatttatgcggtattcattggtgcctaaagaactttaggcatcctctggaaaaccggcccagcacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgcggtggacacctactgcagacacaactacggggttgtgtgagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453369 - DNA, 2188 bp, Homo sapiens
gaggggggccatagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaacgtaagtgcacattgtgactgcagagctactatggggtgggggcaaaaataggaagttttgttaacattgtgcccaggctatgtctcttatgaaattgtgacactttcttcagagattgcccatctttatcagatggatcccaaattatttccaccacaaaaggcgcttggctacttgtcctgtccatgagatttgtgtaaagggcctacacacaggtcatttcttctcaaatctccaccaataaaacctatgcatcacatgtcctcagggtctttagaggatttagaaataagtatgctaaaataatttccccatacagcacttccctttattatgttgacttatgtcagacaaaaggaggtttttactgaaaattttgtgggagtcaagggaattcaaagggtctctcctagacgatccagtgttatgtcctccacaggacctttggtgttggcccctcttcctcatatgtgaggatggatccagtggcctccccattatctcctttcttttctttctgaactccaatgtttataaagcctgtacccctgttgcctatgtaggttctctgacaaaagttatacttagtgctctttctttcttatggggaaaaatccgtggaactgaagctgagatctttagtacgtggagtcaccttacagatatagagcatttatgcggtattcattggtgcctaaagaactttaggcatcctctggaaaaccggcccagaactccacacttctgacgtttctcattcctgtctaagctcttgtgtgtttggtttttggccatcacgttcactgctctttaagctcccccagcggagtggagaggtctgttttcctttgtttggattcctagaggcagcgcagaccaggcacaaggtcagcactaaggaagggttcacgggatgaacacggtgggtgctgttgaaggaaccggtaaagcgtgtgggatgagaggagcagagagtgtctttcagcacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgcggtggacacctactgcagacacaactacggggttgtgtgagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453370 - DNA, 1203 bp, Homo sapiens
gaggggggccatagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgcggtggacacctactgcagacacaactacggggttgtgtgagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453371 - DNA, 1550 bp, Homo sapiens
gagaccaaagcgggtaaggttgcagcctcgaaactggggcagaaggtgtctgccgtgaatgtggtcatcttcactgtcagctcaggaatcctgttggctgaagtccagagtgtccttgctgattcctgaagtagaatggaacagcccggcccctaggaaggagcagggccaagcaacgaagcccccggactcccactcagcatcttggctctgggcagattcagacccgtgctcttccatgtccactgtggagagggctcatcaggctttgggtgctccacttggcaaggtgtaaacctctccaacttccgaggaactgtttccagcatcaccagggtctggaaggtccagtactcggcgctagcccgccccagctccgtcaccgcccggtactcccctggtcctgtcctgttctccagcatggtgtgtctgaagttccctggaggctcctgcatggcagctctgacagtgacactgatggtgctgagctccccactggctttggctggggacacccgaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgcggtggacacctactgcagacacaactacggggttgtgtgagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453372 - DNA, 1206 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453373 - DNA, 1355 bp, Homo sapiens
tgtcacggttacaaaggatgataaataggtgccaagtggagcactcaagtgtgatgagccccctcacagtggaatggagtgagaagctttctgacctcataaactgaaggctatcttcagtcattgttttatatattttacgtgcattaatcctcatataaccccaagaggtaaattagtataattatccttcattgtaggtgacaaagttgagacacagaagaatcaaaaaactcttccaggatcaaccagtaaaaggcagaccttggatttcgaaccaggcaacatggctcagatatcagttttaattactacactctgtactgtcaaagatttgtaaacactttgacaatgcatgccgatttaaaactatgaagaaacaaacacaatttttcacaacatctctcaaatctaatgggtcctcactatcaagattaaattccaggctgatgacactgtaaggccacatggccagctgtgctggaggcctggtcaaggtcagagcctgggtttgcagagaagcagacaaacagccaaataaggagacttactctgtcttcatgactcattcccactaccttttttttctcctagtctcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453374 - DNA, 1967 bp, Homo sapiens
gaggggggccatagttctccctgattgagacttgcctgctgctgtgaccactggtcttgtcctcttctccagcatggtgtgtctgaagctccctggaggctcctgtatggcagcgctgacagtgacattgacggtgctgagctccccactggctttggctggggacacccaacgtaagtgcacattgtgactgcagagctactatggggtgggggcaaaaataggaagttttgttaacattgtgcccaggctatgtctcttatgaaattgtgacactttcttcagagattgcccatctttatcagatggatcccaaattatttccaccacaaaaggcgcttggctacttgtcctgtccatgagatttgtgtaaagggcctacacacaggtcatttcttctcaaatctccaccaataaaacctatgcatcacatgtcctcagggtctttagaggatttagaaataagtatgctaaaataatttccccatacagcacttccctttattatgttgacttatgtcagacaaaaggaggtttttactgaaaattttgtgggagtcaagggaattcaaagggtctctcctagacgatccagtgttatgtcctccacaggacctttggtgttggcccctcttcctcatatgtgaggatggatccagtggcctccccattatctcctttcttttctttctgaactccaatgtttataaagcctgtacccctgttgcctatgtaggttctctgacaaaagttatacttagtgctctttctttcttatggggaaaaatccgtggaactgaagctgagatctttagtacgtggagtcaccttacagatatagagcatttatgcggtattcattggtgcctaaagaactttaggcatcctctggaaaaccggcccagcacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgcggtggacacctactgcagacacaactacggggttgtgtgagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaaaaaaattatctggtccatttggctgcaaggac

SEQ ID NO: 453375 - DNA, 1205 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctcaaacatggagttaaaaa

SEQ ID NO: 453376 - DNA, 982 bp, Homo sapiens
  misc_feature (971)..(972): n is a, c, g, or t
  misc_feature (977)..(978): n is a, c, g, or t
  misc_feature (980)..(980): n is a, c, g, or t
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggtaataccttttcatcctctttaagaaacagatttggaggccaggcgcagtgtcacgcctgtaatcccagcactttgggaggccgaggcgggcgaatcatgaggtcnngagtnngnga

SEQ ID NO: 453377 - DNA, 1169 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctcctgttcttggcctgaagcctcacagctttgatggcagtgcctcatcttcaacttttgtgcttccctttacctaaactgtcctgcctcccgtgcatctgtactccccttgtgccacacattacattattaaatgtttctcaaacatggagttaaaa

SEQ ID NO: 453378 - DNA, 897 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagacactctggacttcagccaacaggactcctgagctgaagtgaagatgaccacattcaaggaggaaccttcttccccagctttgcaggatgaaaagctttcccacctggctgttattcttccataagagagggctttctcaggatctggttgctactggttcagcaac

SEQ ID NO: 453379 - DNA, 1173 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctcaaacatggagttaaaaa

SEQ ID NO: 453380 - DNA, 1115 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcagctctgcagaaaatgtcctcccttgtggctgcctcagctcgtacctttggcctgaagtcccagcattaatggcagcccctcatcttccaagttttgtgctcccctttacctaatgcttcctgcctcccatgcatctgtactcctgctgtgccacaaacacattacattattaaatgtttctcaaacatggagttaaaaa

SEQ ID NO: 453381 - DNA, 566 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtcgagcctaaggtgactgtgtatccttcaaagacccagcccctgcagcaccacaacctcctggtctgcagtaggtgtccacctcggcccgcctccgctccaggaggtcctggctgttcc

SEQ ID NO: 453382 - DNA, 279 bp, Homo sapiens
gaggatcatggatactcatggcgatctctgatagtcgaccctgaatgtgatgccacagatgggtcatctgggcgctcggctgacagagtgccgtgaccgggaggatctccgtgtagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453383 - DNA, 476 bp, Homo sapiens
tgcgggtggggccggttaaggttcccagcgcccgcaccccgcccagggagtccgggttggtggcgtcgctgtcagtgtcttctcaggaggccgcccgtgtgaccggatcgttcgtgtccccacagcacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgcggtggacacctactgcagacacaactacggggttgtgtgagagcttcacagtgcagcggcgaggtgagcatggtggagggcggggcctgggtccctgtgagcggggaatctgtgtatgtgtgtgtgtgtgtgtgtgtgtgaga

SEQ ID NO: 453384 - DNA, 1544 bp, Homo sapiens
gagaccaaagcgggtaaggttgcagcctcgaaactggggcagaaggtgtctgccgtgaatgtggtcatcttcactgtcagctcaggaatcctgttggctgaagtccagagtgtccttgctgattcctgaagtagaatggaacagcccggcccctaggaaggagcagggccaagcaacgaagcccccggactcccactcagcatcttggctctgggcagattcagacccgtgctcttccatgtccactgtggagagggctcatcaggctttgggtgctccacttggcaaggtgtaaacctctccaacttccgaggaactgtttccagcatcaccagggtctggaaggtccagtactcggcgctagcccgccccagctccgtcaccgcccggtactcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctcctgttcttggcctgaagcctcacagctttgatggcagtgcctcatcttcaacttttgtgcttccctttacctaaactgtcctgcctcccgtgcatctgtactccccttgtgccacacattacattattaaatgtttctcaaacatggagttaaaa

SEQ ID NO: 453385 - DNA, 855 bp, Homo sapiens
tacccagttcgacggagactctcaccaaccccgcggtggacacctactgcagacacaactacggggttgtggagagcttcacagtgcagcggcgagtcgagcctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453386 - DNA, 1251 bp, Homo sapiens
gagaccaaagcgggtaaggttgcagcctcgaaactggggcagaaggtgtctgccgtgaatgtggtcatcttcactgtcagctcaggaatcctgttggctgaagtccagagtgtccttgctgattcctgaagtagaatggaacagcccggcccctaggaaggagcagggccaagcaacgaagcccccggactcccactcagcatcttggctctgggcagattcagacccgtgctcttccatgtccactgtggagagggctcatcaggctttgggtgctccacttggcaaggtgtaaacctctccaacttccgaggaactgtttccagcatcaccagggtctggaaggtccagtactcggcgctagcccgccccagctccgtcaccgcccggtactcccctggtcctgtcctgttctccagcatggtgtgtctgaagttccctggaggctcctgcatggcagctctgacagtgacactgatggtgctgagctccccactggctttggctggggacacccgaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctgggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctccgtacctttggcctgaagtcccagcattaatggcagcccctcatcttccaagttttgtgctcccctttacctaatgcttcctgcctcccatgcatctgtactcctgcttgtgccacaaacacattacattattaaatgtttctcaaacatggagttaaaa

SEQ ID NO: 453387 - DNA, 1397 bp, Homo sapiens
ggtggagaggggtcatagttctccctgagtgagactcacctgctcctctggcccctggtcctgtcctgttctccagcatggtgtgtctgaagttccctggaggctcctgcatggcagctctgacagtgacactgatggtgctgagctccccactggctttggctggggacacccgaccacgtttcttggagcaggttaaacatgagtgtcatttcttcaacgggacggagcgggtgcggttcctggacagatacttctataaccaagaggagtacgtgcgcttcgacagcgacgtgggggagtaccgggcggtgacggagctggggcggcctgacgccgagtactggaacagccagaaggacctcctggagcagaggcgggccgcggtggacacctactgcagacacaactacggggttgtggagagcttcacagtgcagcggcgagtctatcctaaggtgactgtgtatcctgcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcacccaagcctgacgagccctctcacagtggaatggagagcacggtctgaatctgcacagagcaagatgctgagtggagtcgggggctttgtgctgggcctgctcttccttggggccgggctgttcatctacttcaggaatcagaaaggacactctggacttcagccaacaggattcctgagctgaagtgaagatgaccacattcaaggaagaaccttctgccccagctttgcaggatgaaacacttccccgcttggctctcattcttccacaagagagacctttctccggacctggttgctactggttcagcaactctgcagaaaatgtcctcccttgtggctgcctcagctcctgttcttggcctgaagcctcacagctttgatggcagtgcctcatcttcaacttttgtgcttccctttacctaaactgtcctgcctcccgtgcatctgtactccccttgtgccacacattacattattaaatgtttctcaaacatggagttaaaaaaaaaacaaaaaaaaaaaaaaaaaaaaacaaaagacaactgagggacatatagaggggggcgcgaaacaaggcacaacaaaggggcccgggcgacaagagggactccacgaaccgagttctgcggaacaaggggcaaacatcggcgggccccacaaagggagcagccgaaaatagcgaagacgcggtaaccgggta

SEQ ID NO: 453388 - DNA, 434 bp, Homo sapiens
gtgacgtttggtctgagctgacctttcctcacaatcgtgaatttgggctgtgaggatcaggccttgtcagaacccgagatgagaggagagagatttctggttcagtaagggtgagagccaggctccagactatagtgaattttccgaggagatatgtgtgggtcctgaataccatcccaagtgtccttataagagagaggcaaaagaggcaatagagacacagaaaagaaagccatgtgaagatggagcagagagatatatggccacaagccaaggaatgctgacagctgccagaagctgaaagaaggcaaggaatggactctcccctacagcctccagaggcaatgcagccctgccaacactttgattttagacttctggcctatagaactgagaaagaataaatttctgttcttttcagctaaaaagtttgt

SEQ ID NO: 453389 - DNA, 5327 bp, Homo sapiens
acgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacaagactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaaaataaaaaaa

SEQ ID NO: 453390 - DNA, 5251 bp, Homo sapiens
accatgatacacagcagaaggaggggggaaaaacacgtagatattgcccttcggcttaaaatccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacaagactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaaaataaaaaaa

SEQ ID NO: 453391 - DNA, 4660 bp, Homo sapiens
aagacactgcctggcttgagtggaacgctcttcacaccagttgttcctaacagaaccattctcattgcggctttctttccttgaattgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaaggctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacaagactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaaaataaaaaaa

SEQ ID NO: 453392 - DNA, 2281 bp, Homo sapiens
accatgatacacagcagaaggaggggggaaaaacacgtagatattgcccttcggcttaaaatccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacaagactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgtta

SEQ ID NO: 453393 - DNA, 402 bp, Homo sapiens
gtgacgtttggtctgagctgacctttcctcacaatcgtgaatttgggctgtgaggatcaggccttgtcagaacccgagatgagaggagagagatttctggttcagtaagggtgagagccaggctccagactatagtgaattttccgaggagatatgtgtgggtcctgaataccatcccaagtgtccttataagagagaggcaaaagaggcaatagagacacagaaaagaaagccatgtgaagatggagcagagagatatatggcctgacagctgccagaagctgaaagaaggcaaggaatggactctcccctacagcctccagaggcaatgcagccctgccaacactggcctatagaactgagaaagaataaatttctgttcttttcagctaaaaagtttgt

SEQ ID NO: 453394 - DNA, 675 bp, Homo sapiens
ggcaggcctgtgaaatagatgttgaatagataatgcccttattttataaatggagaaattgaagcataaaatcacatagctcacttatcacacagaaagttaatggtggaaacacaggcttccttccaggacactgctacttcctctgtcctgttgcttaaaaactgcacgtctgccggccacagtggtgcatgcctgtagcctaagctactcaggaggctgaggtgggaggatcatttgagctaaggattattaatagaatctagccttgacaacatagttgagaccctgtctgtaaaacaaaataaaggtctttagcagttagcccatttcacagcatacatttctgatctccatgtataactaatttaggaaatggataatattattcaaaatttgtttcttatatgctaatatttttctctccctgctaatatttttcacttgtcttctactcttagcccccattcactggggagaatagaaagaaaacaattgacaaaatcctcaaatgtaaactcaatttgcctccctacctcacacaagaagccagagatctgcttaaaaagtaaggttcttaaatggtcactgacactacaagattcaatgactaggatttaactagatagaatttaatgtatattttgaataaagagtcatatataaatattgaac

SEQ ID NO: 453395 - DNA, 5346 bp, Homo sapiens
acgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaagatgatctcttttcctttaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaaaaaaggtggagagggagatgtgtgagcatcctgcaaggtgaaacaagactcaaaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaaaataaaaaaa

SEQ ID NO: 453396 - DNA, 5290 bp, Homo sapiens
acgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcacccccattcactggggagaatagaaagaaaacaattgacaaaatcctcaaatgtaaactcaatttgcctccctacctcacacaagaagccagagatctgcttaaaaagctgctgaaaagaaatgctgcttctcgtctgggagctggtcctggggacgctggagaagttcaagctcatccattctttagacacattaactgggaagaacttctggctcgaaaggtggagcccccctttaaacctctgttgcaatctgaagaggatgtaagtcagtttgattccaagtttacacgtcagacacctgtcgacagcccagatgactcaactctcagtgaaagtgccaatcaggtctttctgggttttacatatgtggctccatctgtacttgaaagtgtgaaagaaaagttttcctttgaaccaaaaatccgatcacctcgaagatttattggcagcccacgaacacctgtcagctcttccttgtcttaaagcccagtcaaattttctcctggggatttctggggaagaggtgcttcggccagcacagcaaatcctcagacacctgtggaatacccaatggaaacaagtggcatagagcagatggatgtgacaatgagtggggaagcatcggcaccacttccaatacgacagccgaactctgggccatacaaaaaacaagcttttcccatgatctccaaacggccagagcacctgcgtatgaatctatgacagagcaatgcttttaatgaatttaaggcaatgacagtttcagagagtcaatgtcattacatagaacacttcagacacaggaaaaataaacgtggattttaaaaaatcaatcaatggtgcaaaaaaaaacttaaagcaaaatagtattgctgaactcttaggcacatcaattaattgattcctcgcgacatcttctcaaccttatcaaggattttcatgttgatgactcgaaactgacagtattaagggtaggatgttgcttctgaatcactgttgagttctgattgtgttgaagaagggttatcctttcattaggcaaagtacaaaattgcctataatacttgcaactaaggacaaattagcatgcaagcttggtcaaactttttccagcaaaatggaagcaaagacaaaagaaacttaccaattgatgttttacgtgcaaacaacctgaatcttttttttatataaatatatatttttcaaatagatttttgattcagctcattatgaaaaacatcccaaactttaaaatgcgaaattattggttggtgtgaagaaagccagacaacttctgtttcttctcttggtgaaataataaaatgcaaatgaatcattgttaaccacagctgtggctcgtttgagggattggggtggacctggggtttattttcagtaacccagctgcaatacctgtctgtaatatgagaaaaaaaaaatgaatctatttaatcatttctacttgcagtactgctatgtgctaagcttaactggaagccttggaatgggcataagttgtatgtcctacatttcatcattgtcccgggcctgcattgcactggaaaaaaaaatcgccacctgttcttacaccagtatttggttcaagacaccaaatgtcttcagcccatggctgaagaacaacagaagagagtcaggataaaaaatacatactgtggtcggcaaggtgagggagatagggatatccaggggaagagggtgttgctgtggcccactctctgtctaatctctttacagcaaattggtaagattttcagttttacttctttctactgtttctgctgtctaccttccttatatttttttcctcaacagttttaaaaagaaaaaaaggtctatttttttttctcctatacttgggctacattttttgattgtaaaaatatttgatggccttttgatgaatgtcttccacagtaaagaaaacttagtggcttaatttaggaaacatgttaacaggacactatgtttttgaaattgtaacaaaatctacataaatgatttacaggttaaaagaataaaaataaaggtaactttacctttcttaaatatttcctgccttaaagagagcatttccatgactttagctggtgaaagggtttaatatctgcagagctttataaaaatatatttcagtgcatactggtataatagatgatcatgcagttgcagttgagttgtatcaccttttttgtttgtcttttataatgtcttcagtctgagtgtgcaaagtcaatttgtaatattttgcaaccctaggatttttttaaatagatgctgcttgctatgttttcaaacctttttgagccataggatccaagccataaaattctttatgcatgttgaattcagtcagaaaagagcaaggctttgctttttgaaattgcaactcaaatgagatgggatgaaatcctatgacagtaagcaaaaacagaaccatgaaaaatgattggacatacaccttttcaattgtggcaataattgaaagaatcgataaaagttcatctttggacagaaagcctttaaaaaaaaaatcactccctcttccccctcctcccttattgcagcagcctactgagaactttgactgttgctggtaaattagaagctacaataataattaagggcagaaattatacttaaaaagtgcagatccttgttctttgacaatttgtgatgtctgaaaaaacagaacccgaaaagctatggtgatatgtacaggcattatttcagactgtaaatggcttgtgatactcttgatacttgttttcaaatatgtttactaactgtagtgttgactgcctgaccaaattccagtgaaacttatacaccaaaatattcttcctaggtcctatttgctagtaacatgagcactgtgattggctggctataaccaccccagttaaaccattttcataattagtagtgccagcaatagtggcaaacactgcaacttttctgcataaaaagcattaattgcacagctaccatccacacaaatacatagtttttctgacttcacatttattaagtgaaatttatttcccatgctgtggaaagtttattgagaacttgtttcataaatggatatccctactatgactgtgaaaacatgtcaagtgtcacattagtgtcacagacagaaagcacacacctatgcaatatggcttatctatatttatttgtaaaaatccaagcatagtttaaaatatgatgtcgatattactagtcttgagtttctaagagggttctttatgttataccaggtaagtgtataaaagagattaagtgcttttttttcatcacttgattattttctttaaaatcagctattacaggatatttttttattttatacatgctgttttttaattaaaatataatcactgaagtttactaatttgattttataaggtttgtagcattacagaataactaaactgggatttataaaccagctgtgattaacaatgtaaagtattaattattgaactttgaaccagatttttaggaaaattatgttctttttccccctttatggtcttaactaatttgaatccttcaagaaggatttttccatactattttttaagatagaagataatttgtgggcaggggtggaggatgcatgtatgatactccataaattcaacattctttactataggtaatgaatgattataaacaagatgcatcttagatagtattaatatactgagccttggattatatatttaatataggacctattttgaatattcagttaatcatatggttcctagcttacaagggctagatctaagattattcccatgagaaatgttgaatttatgaagaatagattttaaggctttgaaaatggttaatttctcaaaaacatcaatgtccaaacatctaccttttttcataggagtagacactagcaagctggacaaactatcacaaaagtatttgtcacacataacctgtggtctgttgctgattaatacagtactttttcttgtgtgattcttaacattatagcacaagtattatctcagtggattatccggaataacatctgaaagatgggttcatctatgtttgtgtttgctctttaaactattgtttctcctatcccaagttcgctttgcatctatcagtaaataaaattcttcagctgccttattaggagtgctatgagggtaacacctgttctgcttttcatcttgtatttagttgactgtattatttgatttcggattgaatgaatgtaaatagaaattaaatgcaaatttgaatgaaaataaaaaaa

SEQ ID NO: 453397 - DNA, 1596 bp, Homo sapiens
acgctgaactttaggagccagtctaaggcctaggcgcagacgcactgagcctaagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagacctggaccagccagaggacgcgggctctgaggatgagctggaggaggggggtcagttaaatgaaagcatggaccatgggggagttggaccatatgaacttggcatggaacattgtgagaaatttgaaatctcagaaactagtgtgaacagagggccagaaaaaatcagaccagaatgttttgagctacttcgggtacttggtaaagggggctatggaaaggtttttcaagtacgaaaagtaacaggagcaaatactgggaaaatatttgccatgaaggtgcttaaaaaggcaatgatagtaagaaatgctaaagatacagctcatacaaaagcagaacggaatattctggaggaagtaaagcatcccttcatcgtggatttaatttatgcctttcagactggtggaaaactctacctcatccttgagtatctcagtggaggagaactatttatgcagttagaaagagagggaatatttatggaagacactgcctgcttttacttggcagaaatctccatggctttggggcatttacatcaaaaggggatcatctacagagacctgaagccggagaatatcatgcttaatcaccaaggtcatgtgaaactaacagactttggactatgcaaagaatctattcatgatggaacagtcacacacacattttgtggaacaatagaatacatggcccctgaaatcttgatgagaagtggccacaatcgtgctgtggattggtggagtttgggagcattaatgtatgacatgctgactggagcagtaggtgcacagttaaaagctgcatgtattattggtctgtgctgagtcactatagcaagagacctgtcctgtgctttctgaacatgttaccagtggagttttcaaagcccaaagatttgttattagcagtttaacactaataatgctgtatgattatatgggatcccatactttccgaaacattttcttttaaatgatctatgtcatggcaggcctgtgaaatagatgttgaatagataatgcccttattttataaatggagaaattgaagcataaaatcacatagctcacttatcacacagaaagttaatggtggaaacacaggcttccttccaggacactgctacttcctctgtcctgttgcttaaaaactgcacgtctgccggccacagtggtgcatgcctgtagcctaagctactcaggaggctgaggtgggaggatcatttgagctaaggattattaatagaatctagccttgacaacatagttgagaccctgtctgtaaaacaaaataaaggtctttagcagttagcccatttcacagcatacatttctgatctccatgtataactaatttaggaaatggataatattattcaaaatttgtttcttatatgctaa

SEQ ID NO: 453398 - DNA, 996 bp, Homo sapiens
ttaatagtgcctgcccccactactgcaagggtgactgccacgagggccagcgcttgttcattcatgtggaacctcatctgtacaaatgtaagagctcttagccgtgcagggaatgttctttctcctgagtggtagtgtgcatttctagccagtggagggcctcatgtggtctcatgatatgcctgagacactgaagcgtgtggcacagtggctagcgcaggactctggagtcagatctggacctgaatgcgtcgcctacctgttgctagctgtgacctgacatcttggagcccctctctgatcacctgtggagttctagcacgtccttctgcaggttgtgtgtgtgagagactgagatgatgggtgcgagtgcctggcatgtatacacactcactgtctccttgggctcacagggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453399 - DNA, 662 bp, Homo sapiens
gcaggctcttcttccagaaactgcgaggatccgagcgcactgtttgtgcaccacaagatggaagagaagaggcgaaaatagtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453400 - DNA, 553 bp, Homo sapiens
tgcacactcagaactagcttgttgcctctgaggttctattttatttcttcagtgagacacatcatttctctgttgggagttgggtatagtcaaaatcacctcttcaaaaagcaactgttttctcctttctcctgacagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453401 - DNA, 861 bp, Homo sapiens
ccttgctgtgcagactctgcattctgcggggctcacgttctttctcctttcagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccagcaggtacagccacttcaggtgttgctgaccgtccacaactgcctgcattcctgacagtcctgttagccaagaggaggaagtgactgagcctgttacaccctcacaggaagtatggttaggggtcctcaagtac

SEQ ID NO: 453402 - DNA, 411 bp, Homo sapiens
tttttttcaaaagaaaaaaaaatagggttttattaactaccacactgttataatacactttaaacgtacaataaggtagcctttaaatttgagggggtcttaagaataacaaatgaacagaattccaaatttttgaaataggtgaactgctgcagttacaggtatacatttaggaaaactgtatagctcttacaagaccagcaatgtaactttattttgtacatttttgaattgaaaatataaacaataattaaaaaataaaaagaaagacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453403 - DNA, 1720 bp, Homo sapiens
actggggttggacaacaaaggcattcttctgggctcttaatgaaaccaaaacttatttctagtctatgtatttatgggatgcctgttattttcgctaaagcattcgctttcccaccagatacagcagctgaggaactcctttctgccacgcggggcgcgggcgagcgttgggggcggaaagaatccgctgccactaggaccaggcggaagaagcatccccgccgacccttggggaaggccgccgcggcacccccagcgcaaccaatcagaaggctccttcgcgcagcggcgcgccaaccgcaggcgccctttctgccgacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453404 - DNA, 1567 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaacaaaaacttcctggagaccattgcctgaaggatggccggggatcaatcatgacagctttgcgagcgct

SEQ ID NO: 453405 - DNA, 2004 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaaaaaaaaaaaaaaaaaaaaaaaaaaaaaaaaaaaaaaaaaaaaaaaaaaacttaaaaaaagccaacagaaccctctaaaaacaaatagaaataaaaacagaaagtccaaaaaggaacagttctttcgaacacaaagaaaaaaccttataaaaaaatttggggccccctcggcccaaggggttttaaaattggcaaagtttttgtatgggggccaaattaggacccatttgggcaattccccctttagggggggggtttaaaaataaagggcgggggttttacaacggggggttggggaaaaaccggggggttccccaatataatgccttggagcaaccccccttttgcagggggggatatggaaaaggggcccccacagtcgttttccaaaatttgccaacctaatggggaagggaattgaaccctattttttggtaaaatcgggggatatttttggaaaacgccttttttaacccaagggccagtggggaaacccttttaaaaaa

SEQ ID NO: 453406 - DNA, 1988 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaatgaaaaaaccctaaaaatacccaaacttatacaccttaaaaaacaaacccctttcaccagctaacattaataacgaaaaggcccaaaccaaacacccttccaaaatatttttcttcctaaatgcctaaatgaatattttaattttttttttccccccattgccccaataatttttgtttaaagaactttttttttggcggcccggttgaagcgcctttttggcattttccccttaaaggagggggtataaaaagactgggggggggtgttcacagggcgaggagggaaaaccccgggggcgcccatctaaaggctgggagaaaaaccccttttggggaggggggaaataagagagggcgcccccataggctttccaaaatgggggccctaaggggtaatggatataccaggggtttttttgttaaaccccgggaaatttttggaaaccccttttttaacacagggcgcaaaggggagcctttttataaa

SEQ ID NO: 453407 - DNA, 1828 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgagtgtacaaaacaacaaaaacccacccaacaacacaaaaaaaatttttgggcaggaggaatgtgcccattgaaaaaccctttttcagaaacccattgatgatagtggcgcggcggccccatagtatgttaactgttaaccctttggtccatacggtgtgttaccatgaagaaaaactctgtggccacatgcaatacacgtggtgggagctttcccccccagttaaaaaaacggcccggtgcgacaaccacgacagcgttttctgaaaaaactcccaagagtggactccgagacgagtatacggggacctaaaaccaggacgtgccaagcaacatccact

SEQ ID NO: 453408 - DNA, 1413 bp, Homo sapiens
ctggctaccgcccccggagattacgggaatatcgctacagaaccacagctgtcagacgtatcacacgcagtccgggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453409 - DNA, 1694 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgatcctcacacctcagcctcccaagcagcctgagagctacgaagtgttgcacagaggcactggcccacgggtagcagtgaggagtgaggcagagcaagagagaaaagcgggaggaccgaaggcgacggcaacaaggaacaagaaagcgagcgcgggggagaagaaagcgagaagccacgaggcggaccaggacgagaggaagagagcgaagagggagggaccagaagcagaaagagcgcgaagagaagccagcaagagagaagagggggcccacaggacacagcggaggcggagaaggagaagagggcaagacaagacgcggaactacaagaagagaagagacaacgacagcaggaagagaaaaaaggaaagcaggccagcggacaaaggcaagcgagagaaaacaggacactgaggagaaagcgaggggaggacacaagaaaaacgaagagcagcgcgaagggaagagacagaggagaagagaaaaagcgaaccagcagccgaggcacagagcacggacgagagaggaagcaggaagacgcagcggg

SEQ ID NO: 453410 - DNA, 1451 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccagatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453411 - DNA, 1185 bp, Homo sapiens
caaatgggttttggggagaggagactgctctgtctttccagccaggaagctgccttgtggctggcaatgatgacatgtgccctctcgctggcttagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453412 - DNA, 2005 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccagcaggtacagccacttcaggtgttgctgaccgtccacaactgtcaggaatgcaggcagtgtggaccgggcagcaacagctgaccgggatcgcgcagagcccgggagccacgaggagcgacagcgaccagtccgaccctgcttaacaccccgtccatcacgcgcaagctactggccaagaggagcgtaacgaaccaaagaataccaccgcacgccggccacacacggcgcacccagcacctacgcaggcgcttctcacgacatcactcactggccaatgcgcgaccgcatacaccacagtacactctaggcgctcgtgacccccccaagcatacaccagccacacgagcgctgcaacccatgacccaaccgaacagggagcacacgaccgccgctaagcattcccatttcccacgtgcctgggcagcgtcaccacgaaaaccaatgaccagcccaccaacagctaaaacgctagcggatcacactcagacaacgctaagtccaccgcggcacaccactgcctacacgtgtcaccaaccccactgcacagctgcagccaccgacggaccgccccatacacctgctaaccgaccaccgaggcaagcgcaaacagcgcggcccccacacacactggccagcggctcgagcacaaagaggaatagacaactgcgcacccagtcaacacgcacacacactggcaacaacgacccgacagagagcgaacaccacgacccgagacctatcgtcctgccgagccccacccaccacaggccagcaccctagcggcaccggacggcagcaccacacgaacacaggcagtaccacccacccgccaccacacaggctcagacccaagcactatggcgacccctcggcccaacacgcatccgcacaccctacacccccggacaccgacacctacacccagaaccggcagagcaccacgcccccggccaaccactgcagctgcccaccgagtagaccactcatagcagccaacagccacctacaccccgcgccacagccatacggagcgacgcgacacagacaacgtcgactcaatcacgccgcccacaacgcacgcacccgacgacaacccg

SEQ ID NO: 453413 - DNA, 1355 bp, Homo sapiens
actggggttggacaacaaaggcattcttctgggctcttaatgaaaccaaaacttatttctagtctatgtatttatgggatgcctgttattttcgctaaagcattcgctttcccaccagatacagcagctgaggaactcctttctgccacgcggggcgcgggcgagcgttgggggcggaaagaatccgctgccactaggaccaggcggaagaagcatccccgccgacccttggggaaggccgccgcggcacccccagcgcaaccaatcagaaggctccttcgcgcagcggcgcgccaaccgcaggcgccctttctgccgacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccagaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453414 - DNA, 1295 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaaggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453415 - DNA, 1191 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcagggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453416 - DNA, 721 bp, Homo sapiens
ccttgtaagaggtctctgtgacctggtcatcctgcctgcctttggaaagttaggatccagtacgcagtggaaatgccctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453417 - DNA, 1360 bp, Homo sapiens
  misc_feature (1065)..(1065): n is a, c, g, or t
actggggttggacaacaaaggcattcttctgggctcttaatgaaaccaaaacttatttctagtctatgtatttatgggatgcctgttattttcgctaaagcattcgctttcccaccagatacagcagctgaggaactcctttctgccacgcggggcgcgggcgagcgttgggggcggaaagaatccgctgccactaggaccaggcggaagaagcatccccgccgacccttggggaaggccgccgcggcacccccagcgcaaccaatcagaaggctccttcgcgcagcggcgcgccaaccgcaggcgccctttctgccgacctcacgggctatttaaaggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcncgaggaccctttactcgtgggagcgattccgagggatcaaggagacatcgaaggcagaagcacgcagtaagagtaaccgcacgagggttcctgcatcgcggtaccccaatgccacgaggacaacttcgggggaggagcccacaaggttgagacaaccagaacggcattgctcagaaacttaaagggcattagacaatggaactgaagagcacagagtatacgcacattacgtaaggtatatagaggaactggaggggctgggcatagatgaagagtacacgccgcaaggaatacc

SEQ ID NO: 453418 - DNA, 861 bp, Homo sapiens
gcacgctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagctctcctgacaggccctgggccaagcccgaggacccttctctcctggaggatcccaggatcaaggcgatcgcagccaagcacaataaaactacagcccagatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453419 - DNA, 890 bp, Homo sapiens
  misc_feature (583)..(583): n is a, c, g, or t
  misc_feature (595)..(596): n is a, c, g, or t
  misc_feature (605)..(605): n is a, c, g, or t
  misc_feature (616)..(616): n is a, c, g, or t
  misc_feature (624)..(625): n is a, c, g, or t
  misc_feature (627)..(627): n is a, c, g, or t
  misc_feature (630)..(630): n is a, c, g, or t
tgcacactcagaactagcttgttgcctctgaggttctattttatttcttcagtgagacacatcatttctctgttgggagttgggtatagtcaaaatcacctcttcaaaaagcaactgttttctcctttctcctgacagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaaaaaaaaaaaaaaaaaaaaatnttggggggggcnntgggcctgngaaaaggtttnaaagaccnntnggntgggggcgcgggggccccatgagggaacagggaacatggggccaaaaggcgggcccacaaggagaaacccggggcacacgaccaaaggcgcgggggttcttccccaaattaaaaaacgcgccggggggaacacgagggggtgtctggacaaatcccaaggggggaggtcacaggaggggacaaacaggggagactcttaacaacagggggccccaaggggagccccgaatacaaaaaataccccggggctcgtggggagc

SEQ ID NO: 453420 - DNA, 1490 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453421 - DNA, 528 bp, Homo sapiens
catgcctgtagtcccagctactcgggaggtgcttggtcaacaaagcaagacatcatctcttaaaacaaacaaacaaacaaattaccaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcgggtaagacagcccctggttggaccttgttttcgtgactggttccctcttcttcttagaagcaatctgcctgccatttctcacattgcattttgttattctgtccctgttgtttgctctctcttttttttttttgagttggggtctccctctgttgcccaggctggagtgcagtggcacaatctcggctcactgcaagctccacctcctgggttcacgccattctcctgcctcagcctcctgagtagctgggactacaggtgcccgccaccacgcccggcta

SEQ ID NO: 453422 - DNA, 1434 bp, Homo sapiens
gataagggaaaaggacagcccctcgaggcgatttaaacatcggcacgagggggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453423 - DNA, 1827 bp, Homo sapiens
  misc_feature (1520)..(1520): n is a, c, g, or t
  misc_feature (1532)..(1533): n is a, c, g, or t
  misc_feature (1542)..(1542): n is a, c, g, or t
  misc_feature (1553)..(1553): n is a, c, g, or t
  misc_feature (1561)..(1562): n is a, c, g, or t
  misc_feature (1564)..(1564): n is a, c, g, or t
  misc_feature (1567)..(1567): n is a, c, g, or t
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaaaaaaaaaaaaaaaaaaaaatnttggggggggcnntgggcctgngaaaaggtttnaaagaccnntnggntgggggcgcgggggccccatgagggaacagggaacatggggccaaaaggcgggcccacaaggagaaacccggggcacacgaccaaaggcgcgggggttcttccccaaattaaaaaacgcgccggggggaacacgagggggtgtctggacaaatcccaaggggggaggtcacaggaggggacaaacaggggagactcttaacaacagggggccccaaggggagccccgaatacaaaaaataccccggggctcgtggggagc

SEQ ID NO: 453424 - DNA, 1976 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaaaaaaaaaaaaaaaaaaaaaaacttaaaaaaagccaacagaaccctctaaaaacaaatagaaataaaaacagaaagtccaaaaaggaacagttctttcgaacacaaagaaaaaaccttataaaaaaatttggggccccctcggcccaaggggttttaaaattggcaaagtttttgtatgggggccaaattaggacccatttgggcaattccccctttagggggggggtttaaaaataaagggcgggggttttacaacggggggttggggaaaaaccggggggttccccaatataatgccttggagcaaccccccttttgcagggggggatatggaaaaggggcccccacagtcgttttccaaaatttgccaacctaatggggaagggaattgaaccctattttttggtaaaatcgggggatatttttggaaaacgccttttttaacccaagggccagtggggaaacccttttaaaaaa

SEQ ID NO: 453425 - DNA, 1605 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtgaaaaaaaaaatcttataactgctacatactttactgaatatttgctagaattaaggctacctgccattgtctagtccgatgcaatcagtgtatgacccctggcggatgcccccaca

SEQ ID NO: 453426 - DNA, 1449 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgaggaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453427 - DNA, 1594 bp, Homo sapiens
actggggttggacaacaaaggcattcttctgggctcttaatgaaaccaaaacttatttctagtctatgtatttatgggatgcctgttattttcgctaaagcattcgctttcccaccagatacagcagctgaggaactcctttctgccacgcggggcgcgggcgagcgttgggggcggaaagaatccgctgccactaggaccaggcggaagaagcatccccgccgacccttggggaaggccgccgcggcacccccagcgcaaccaatcagaaggctccttcgcgcagcggcgcgccaaccgcaggcgccctttctgccgacctcacgggctatttaaatcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453428 - DNA, 1125 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccagaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453429 - DNA, 1465 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453430 - DNA, 1367 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcgattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453431 - DNA, 1194 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccagatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtga

SEQ ID NO: 453432 - DNA, 877 bp, Homo sapiens
aaacatagctttcttcccgtaaaaactatctgaaagtaaagttgtatgtaagctgaaaaaaaaaaaaaaaaaaaaaaaaaaaaaaaaaaaaaaaaaaaaaaaaaaagggtacgcgccgcggccaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcgggtaagacagcccctggttggaccttgttttcgtgactggttccctcttcttcttagaagcaatctgcctgccatttctcacattgcattttgttattctgtccctgttgtttgctctctcttttttttttttgagttggggtctccctctgttgcccaggctggagtgcagtggcacaatctcggctcactgcaagctccacctcctgggttcacgccattctcctgcctcagcctcctgagtagctgggactacaggtgcccgccaccacgcccggcta

SEQ ID NO: 453433 - DNA, 4816 bp, Homo sapiens
gcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccc

SEQ ID NO: 453434 - DNA, 3612 bp, Homo sapiens
gcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctatctgtgtttaagatattattggggggtttcttctatcttttaactctcttatctatt

SEQ ID NO: 453435 - DNA, 4171 bp, Homo sapiens
ggttctggaagttggcttccatctcagagaagacgcccagctttccccgttgaccgtggcttcaggactcttgggagacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccc

SEQ ID NO: 453436 - DNA, 408 bp, Homo sapiens
gagtgatagaatgatgactgactgactgacaggatgctgaatgagtgaatggttttataatctgtttgtgtggctgattcaggcttttgtaccctgattgatgattgcttgggcgggaaagtgctgatacacctagatataatggaacatttctgtgccaaggtggcagggcatggtggtatagcctggtatagggtggtattataccaccaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccc

SEQ ID NO: 453437 - DNA, 213 bp, Homo sapiens
acacagctggcaggttcaggctgaagtttcagccctggtcttttggccccagagctcatgacctctgtgtgatgaatcacacggtgggcacccactgagagctatgggagggatgaatgacggagtacatgaggacctgtctccaacccaggggatgaggcccagccccagaacctggagtgcttctttgacggggccgccgtgctcagctgc

SEQ ID NO: 453438 - DNA, 319 bp, Homo sapiens
cgctttttatggagttcgggtcacgtgcgcattgcaatctgcacggctttccattgctttcatgttgaaaccctacagttttgcagatgaagggctgaggctcacagaggagacgggtcttgctcaaggtccctcagctgctgggggcaggggtggcctggaaccccctgtgtccacacaaaaggccatgcaggccctgactgccccccagcggtccagcccttaggtgcccttcacttcctcccctccagtccagcctcctgagcccagggacctgcagatcagcaccgaccaggaccacttcctgctgacctggagt

SEQ ID NO: 453439 - DNA, 3949 bp, Homo sapiens
gcctggaggaggcagaggccaggagggagaggtcccaagagcctgtgaaatgggtctggcctggctcccagctgggcaggaacacaggacttcaggacactaaggaccctgtcatgcccatggccagcacccaccagtgctggtgcctgcctgtccagagctgaccagggagatggtgctggcccaggggctgctctccatggccctgctggccctgtgctgggagcgcagcctggcaggggcagaagaaaccatcccgctgcagaccctgcgctgctacaacgactacaccagccacatcacctgcaggtgggcagacacccaggatgcccagcggctcgtcaacgtgaccctcattcgccgggtgaatgaggacctcctggagccagtgtcctgtgacctcagtgatgacatgccctggtcagcctgcccccatccccgctgcgtgcccaggagatgtgtcattccctgccagagttttgtcgtcactgacgttgactacttctcattccaaccagacaggcctctgggcacccggctcaccgtcactctgacccagcatgtccagcctcctgagcccagggacctgcagatcagcaccgaccaggaccacttcctgctgacctggagtgtggcccttgggagtccccagagccactggttgtccccaggggatctggagtttgaggtggtctacaagcggcttcaggactcttgggaggacgcagccatcctcctctccaacacctcccaggccaccctggggccagagcacctcatgcccagcagcacctacgtggcccgagtacggacccgcctggccccaggttctcggctctcaggacgtcccagcaagtggagcccagaggtttgctgggactcccagccaggggatgaggcccagccccagaacctggagtgcttctttgacggggccgccgtgctcagctgctcctgggaggtgaggaaggaggtggccagctcggtctcctttggcctattctacaagcccagcccagatgcaggggaggaagagtgctccccagtgctgagggaggggctcggcagcctccacaccaggcaccactgccagattcccgtgcccgaccccgcgacccacggccaatacatcgtctctgttcagccaaggagggcagagaaacacataaagagctcagtgaacatccagatggcccctccatccctcaacgtgaccaaggatggagacagctacagcctgcgctgggaaacaatgaaaatgcgatacgaacacatagaccacacatttgagatccagtacaggaaagacacggccacgtggaaggacagcaagaccgagaccctccagaacgcccacagcatggccctgccagccctggagccctccaccaggtactgggccagggtgagggtcaggacctcccgcaccggctacaacgggatctggagcgagtggagtgaggcgcgctcctgggacaccgagtcggtgctgcctatgtgggtgctggccctcatcgtgatcttcctcaccatcgctgtgctcctggccctccgcttctgtggcatctacgggtacaggctgcgcagaaagtgggaggagaagatccccaaccccagcaagagccacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgcccttatgagcaggagaaagaaagacaccactcctaaaacctgggaaggccccagagcatgaagaatgggcttattccccatgtgttcctctctgaatcctaaccagcccaagggttttgtactggagagttttttctccatagccacgcctccgtagtacatgttttgaaagccacagggagagagatgagaagaggtatgatgactctacgaat

SEQ ID NO: 453440 - DNA, 3236 bp, Homo sapiens
  misc_feature (35)..(36): n is a, c, g, or t
  misc_feature (43)..(44): n is a, c, g, or t
tgatggccggagcttatggagagagaggccaagcnnagcgagnncacctgttccagaacgggagcgcagagctttggcccccaggcagcatgtcggccttcactagcgggagtcccccacaccaggggccgtggggcagccgcttccctgagctggagggggtgttccctgtaggattcggggacagcgaggtgtcacctctcaccatagaggaccccaagcatgtctgtgatccaccatctgggcctgacacgactccagctgcctcagatctacccacagagcagccccccagcccccagccaggcccgcctgccgcctcccacacacctgagaaacaggcttccagctttgacttcaatgggccctacctggggccgccccacagccgctccctacctgacatcctgggccagccggagcccccacaggagggtgggagccagaagtccccacctccagggtccctggagtacctgtgtctgcctgctggggggcaggtgcaactggtccctctggcccaggcgatgggaccgggacaggccgtggaagtggagagaaggccgagccagggggctgcagggagtccctccctggagtccgggggaggccctgcccctcctgctcttgggccaagggtgggaggacaggaccaaaaggacagccctgtggctatacccatgagctctggggacactgaggaccctggagtggcctctggttatgtctcctctgcagacctggtattcaccccaaactcaggggcctcgtctgtctccctagttccctctctgggcctcccctcagaccagacccccagcttatgtcctgggctggccagtggaccccctggagccccaggccctgtgaagtcagggtttgagggctatgtggagctccctccaattgagggccggtcccccaggtcaccaaggaacaatcctgtcccccctgaggccaaaagccctgtcctgaacccaggggaacgcccggcagatgtgtccccaacatccccacagcccgagggcctccttgtcctgcagcaagtgggcgactattgcttcctccccggcctggggcccggccctctctcgctccggagtaaaccttcttccccgggacccggtcctgagatcaagaacctagaccaggcttttcaagtcaagaagcccccaggccaggctgtgccccaggtgcccgtcattcagctcttcaaagccctgaagcagcaggactacctgtctctgcccccttgggaggtcaacaagcctggggaggtgtgttgagacccccaggcctagacaggcaaggggatggagagggcttgccttccctcccgcctgaccttcctcagtcatttctgcaaagccaaggggcagcctcctgtcaaggtagctagaggcctgggaaaggagatagccttgctccggcccccttgaccttcagcaaatcacttctctccctgcgctcacacagacacacacacacacacgtacatgcacacatttttcctgtcaggttaacttatttgtaggttctgcattattagaactttctagatatactcattccatctccccctcatttttttaatcaggtttccttgcttttgccatttttcttccttcttttttcactgatttattatgagagtggggctgaggtctgagctgagccttatcagactgagatgcggctggttgtgttgaggacttgtgtgggctgcctgtccccggcagtcgctgatgcacatgacatgattctcatctgggtgcagaggtgggaggcaccaggtgggcacccgtgggggttagggcttggaagagtggcacaggactgggcacgctcagtgaggctcagggaattcagactagcctcgattgtcactccgagaaatgggcatggtattgggggtcgggggggcggtgcaagggacgcacatgagagactgtttgggagcttctggggagccctgctagttgtctcagtgatgtctgtgggacctccagtcccttgagaccccacgtcatgtagagaagttaacggcccaagtggtgggcaggctggcgggacctggggaacatcaggagaggagtccagagcccacgtctactgcggaaaagtcaggggaaactgccaaacaaaggaaaatgccccaaaggcatatatgctttagggcctttggtccaaatggcccgggtggccactcttccagatagaccaggcaactctccctcccaccggccacagatgaggggctgctgatctatgcctgggcctgcaccagggattatggttcttttaaatctttgcctttcagatacaggaaaaataatggcattaaattgctttaatttgcattattttagttatccagtttgcacatatttttataggtatcttaggcatcgattggtattttttaactgggccaagcccattaaggtctttcttctgttgggtgctatcattttctgattaagtctttttgactattgacatacagtctttcacagatggtggagtgtttttcccccaaatctgttgtttgtcttataatgttgtatatgaggttttatggtgtatgaatatgaatgcttctgtaatgtcaaacagatccctagtaaactccttcttcacttttactgtcagatttacaaaggtcctcccattgcaaagcagtgtttgtcctaatttatatattgtttttctagttcattttgtgtttccaacttttcatgtaaaattttaattatttttgaatgtgtggatgtgagactgaggtgccttttggtactgaaattctttttccatgtacctgaagtgttacttttgtgatataggaaatccttgtatatatactttattggtccctaggcttcctattttgttaccttgctttctctatggcatccaccattttgattgttctacttttatgatatgttttcataagtggttaagcaagtattctcgttacttttgctcttaaatccctattcattacagcaatgttggtggtcaaagaaaatgataaacaacttgaatgttcaatggtcctgaaatacataacaacattttagtacattgtaaagtagaatcctctgttcataatgaacaagatgaaccaatgtggattagaaagaagtccgagatattaattccaaaatatccagacattgttaaagggaaaaaattgcaataaaatatttgtaacataaaacaaagtgaaaccc

SEQ ID NO: 453441 - DNA, 149 bp, Homo sapiens
tcttggagtaccttcatatatatcttctttttaatttcttctctggcaattctttcctggattctttgctttgcataattatacctgcttcctgcttctgctattgacagtggataaaacactgaggaaataaattttttttcattttg

SEQ ID NO: 453442 - DNA, 12918 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttg

SEQ ID NO: 453443 - DNA, 12731 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgtagttgtttaaaatggaaaataaaagctgagttcttttggcaaatatattgcatcaaaaatacagtattgacagtggataaaacactgaggaaataaattttttttcattttg

SEQ ID NO: 453444 - DNA, 11289 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtcctgctttctttacctttttctcaagtcacatatctatctagcaggatatatgtctgtcagtcagtcactagctctctctctctctctctaactctctct

SEQ ID NO: 453445 - DNA, 11921 bp, Homo sapiens
cctttgtttcctcttaattttattgttgatagtctatacaactctttctgaggccagttgaagaactcaaagatttggaagttcagttcatttcgtgagtagaatgctttctttgtgcagctgtgaaacagaaagcagctctttggagaactacttgagaaattatttatacttgatttactgtatgcagtgaattctttccattgttaaacagtagaaaagcagatcatacatttattttaacatttcaaaatatgtgtttgaaacagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttg

SEQ ID NO: 453446 - DNA, 10277 bp, Homo sapiens
gaggaatatgggaccaaaataaatgaaactttcaggaaaagatttaaacaacagagatcttaaaaataggaaattgaggttgaagagaagatggcaaggctagataataagtcaaaaacattatttttaaagaaacaattttctttaaataaatgacagatactttttgtgtattacctgatatgatagattgacagtatacatgtgaaaacagtttggattaataagttcactttacccatgagggtgggaagtcaagggaaagccaggctcagctgctatttacatctctgacctaggctcttgtttgacctaagtctgtcttgatgcagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttg

SEQ ID NO: 453447 - DNA, 12297 bp, Homo sapiens
  misc_feature (4340)..(4340): n is a, c, g, or t
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtggtaggtttttctttatttttacaacatgataaattttcagattaaatctgaaatatgtatttacatagatagctataaaagccataaaaattgatgaagttacacaaaaattttttgaaaactatggcaaaatcactttgctgccctccagtggctctctttttctaagtcctttgataagaaacaaaagtacaaggttaagaaaccctggcatagagtattttaaaaagtgttttggaaagtatttgtcaatgcttagagatagaaatggctgtgttatatataggaagtaaattttctcaactatacccagatatgtgtttgaaaagtaaaaccctccctactttttggctatagtgtattcctggaaactgcataggaaagcaaacatgggaagatgattgttttattgttttctacttttaaatggtatgggaaccttgagatagcaaaatgctgcctagtactatgccaaatacagtcaacttttgatgctttctgaggaaaagaaaactggtaaactgatggatggatgagttgaagttaaatatagtatagtaatttgtatagcctcaggtgagcagcttgccaaaacaaacaaacaaacaaacaaacaggggtgagggatttggaaatatagtaacaacaatgataagagactgtgggaagaaatgagagttgctgccatcagatccaatgcagtggggctcagatttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgcctgtaatcccagctcctctggaggctaaggcagaaaattncttgaaccgggacccaggaggcagaggttgcagtgggctgagatcacgccactgcactccagcctgggctacagagggagactctgtctcaaaacaaacaaaaaaagcgtagtgtgctaatgctaatgcacattgtgtttttgcaggatatgaatatagaatatgcgtgatttctggagtttgctacaatttgttaatgaatattctaaggcaaatccatcacatactttcaattgcaataaaatatgtatttttttctaaatcttatgtgtccttgcattcatttttcccactttctggttttccccctttgtaaagctctctctctctctctaaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttg

SEQ ID NO: 453448 - DNA, 12146 bp, Homo sapiens
  misc_feature (4340)..(4340): n is a, c, g, or t
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtggtaggtttttctttatttttacaacatgataaattttcagattaaatctgaaatatgtatttacatagatagctataaaagccataaaaattgatgaagttacacaaaaattttttgaaaactatggcaaaatcactttgctgccctccagtggctctctttttctaagtcctttgataagaaacaaaagtacaaggttaagaaaccctggcatagagtattttaaaaagtgttttggaaagtatttgtcaatgcttagagatagaaatggctgtgttatatataggaagtaaattttctcaactatacccagatatgtgtttgaaaagtaaaaccctccctactttttggctatagtgtattcctggaaactgcataggaaagcaaacatgggaagatgattgttttattgttttctacttttaaatggtatgggaaccttgagatagcaaaatgctgcctagtactatgccaaatacagtcaacttttgatgctttctgaggaaaagaaaactggtaaactgatggatggatgagttgaagttaaatatagtatagtaatttgtatagcctcaggtgagcagcttgccaaaacaaacaaacaaacaaacaaacaggggtgagggatttggaaatatagtaacaacaatgataagagactgtgggaagaaatgagagttgctgccatcagatccaatgcagtggggctcagatttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgcctgtaatcccagctcctctggaggctaaggcagaaaattncttgaaccgggacccaggaggcagaggttgcagtgggctgagatcacgccactgcactccagcctgggctacagagggagactctgtctcaaaacaaacaaaaaaagcgtagtgtgctaatgctaatgcacattgtgtttttgcaggatatgaatatagaatatgcgtgatttctggagtttgctacaatttgttaatgaatattctaaggcaaatccatcacatactttcaattgcaataaaatatgtatttttttctaaatcttatgtgtccttgcattcatttttcccactttctggttttccccctttgtaaagctctctctctctctctaaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacagtattgacagtggataaaacactgaggaaataaattttttttcattttg

SEQ ID NO: 453449 - DNA, 6132 bp, Homo sapiens
  misc_feature (4340)..(4340): n is a, c, g, or t
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtggtaggtttttctttatttttacaacatgataaattttcagattaaatctgaaatatgtatttacatagatagctataaaagccataaaaattgatgaagttacacaaaaattttttgaaaactatggcaaaatcactttgctgccctccagtggctctctttttctaagtcctttgataagaaacaaaagtacaaggttaagaaaccctggcatagagtattttaaaaagtgttttggaaagtatttgtcaatgcttagagatagaaatggctgtgttatatataggaagtaaattttctcaactatacccagatatgtgtttgaaaagtaaaaccctccctactttttggctatagtgtattcctggaaactgcataggaaagcaaacatgggaagatgattgttttattgttttctacttttaaatggtatgggaaccttgagatagcaaaatgctgcctagtactatgccaaatacagtcaacttttgatgctttctgaggaaaagaaaactggtaaactgatggatggatgagttgaagttaaatatagtatagtaatttgtatagcctcaggtgagcagcttgccaaaacaaacaaacaaacaaacaaacaggggtgagggatttggaaatatagtaacaacaatgataagagactgtgggaagaaatgagagttgctgccatcagatccaatgcagtggggctcagatttaacactgataatgaggttcaaagcttaaggagaaaagactataaatgtgagaagagaagccactaacgattcacagtaagtggttttagtagattcgctagctatacagttataaaatcttaaggttttttcttaagcattccctgagaaaaatcttaagattttagacacttttctagtcaattatttacaataggtttattgattaattaactttgttttagttcacttcctattgtcaccttctatagtttctggtaatcataacatattcataaagagtaggctgggcgcagtggctcctgcctgtaatcccagcactttgagaggccgaggcgggtggatcacgaggtcaagagttcaagaccagcctggccaagatggtaaaatcccgtctctacaaaaaatagaaaaagaattagccgggcatggtggcaggtgcctgtaatcccagctcctctggaggctaaggcagaaaattncttgaaccgggacccaggaggcagaggttgcagtgggctgagatcacgccactgcactccagcctgggctacagagggagactctgtctcaaaacaaacaaaaaaagcgtagtgtgctaatgctaatgcacattgtgtttttgcaggatatgaatatagaatatgcgtgatttctggagtttgctacaatttgttaatgaatattctaaggcaaatccatcacatactttcaattgcaataaaatatgtatttttttctaaatcttatgtgtccttgcattcatttttcccactttctggttttccccctttgtaaagctctctctctctctctaaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacagcagatggacatggcctctaggaaggagatgcctcagaccccatatcccaggaggaaaaggaaactgcgcgttcaaggtggccaaagagtaactgatcctttcctctcccacactcaggcagtctttatgattcagtcaggcttcaaccatattccgagtatctgaactggaagcagggaggggcaggatgagaaccacagctggtagccaca

SEQ ID NO: 453450 - DNA, 1227 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaaggtaagaacgttatactttaccatgatgtcatatactgtggtgaccagagttaatttgtagaatatgctgcatacaatttggcagaagtttataacaatttaatatgatatttaaggaaacattaacataaaatgttatggtgatagtagtaatacagagttacacatgcttttagct

SEQ ID NO: 453451 - DNA, 220 bp, Homo sapiens
atatatatgtagaatattgagggggaataaaatactttttagtcagactaaaaagtgttttactatttatcattataaataattggaatttatttcattgagtaatctgagttaattgaaattgtaatttaatctgaattcttttttttttgtcttgttcatgttagggtatcatttattatgttacgacctcgtctaagctagaggagtggctagctaa

SEQ ID NO: 453452 - DNA, 344 bp, Homo sapiens
tcaaaaaaaaaaaaaaaaaaaagtgtatgagagaagaaaattaaagggcttagataactgataagctaattgagtaactgttgaattatgaagatattttattttgaataaacatattaaataaatattgaagatattttaagcctttcaatgctgactttcttttagctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattgg

SEQ ID NO: 453453 - DNA, 11248 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgaga

SEQ ID NO: 453454 - DNA, 7745 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatcctt

SEQ ID NO: 453455 - DNA, 3399 bp, Homo sapiens
cctttgtttcctcttaattttattgttgatagtctatacaactctttctgaggccagttgaagaactcaaagatttggaagttcagttcatttcgtgagtagaatgctttctttgtgcagctgtgaaacagaaagcagctctttggagaactacttgagaaattatttatacttgatttactgtatgcagtgaattctttccattgttaaacagtagaaaagcagatcatacatttattttaacatttcaaaatatgtgtttgaaacagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttataggtgaatacatttgtaatgtacctttgtgaacaattggatattcatatttttggtggtaatggtgagtacttctttataaaaattatagattacagtattacctttatagatcatgaagtaataaactgaccattaaaatgcttttccagttttcacttcaggcttgaaattagaaaaaaaaaagacattaagtgattgaagactgagaagcaattaatttgtggataggaaaaaatagtcaagtctgctactttagagaaagagccaggtataatgaagcagatgtttaagaagttataaaataatgtctgcaactaaaagttctagtgaatttacatggagcctacatatacttaagaggtattcataaaagatcatc

SEQ ID NO: 453456 - DNA, 12870 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtctcctcctcctcgtttgctgcctcctcctcctcctgcagcagcaccagcgaccgccgaagcgccggctcgctcacccggagctccggaggtggatagacggggcagctgcaggctccggcgaccgaggccgagctggggccggggcggggacggcggcggcggcggcggcgacggcggcggcgccgggtggggatggggtcgcagacgctgcagatcctccgacagggggtgtgggccgcgctcagcgggggctggtactacgacccgcaccaggccaccttcgtgaacgcgctgcacctctacctgtggctctttctgctgggcctacccttcaccctctacatggcccttccttctaccatgattatagtagcagtttattgtcctgtgatagctgctgttttcattgttctgaagatggtcaactatcgactacacagagcacttgatgctggagaagttgtagataggactgcaaatgagttcacggatcagcgaaccaaagctgaacaaggcaactgttcaaccaggagaaaagacagcaatggaccgagtgatcctggtggagggattgaaatgtctgagttcatccgagaggccacacccccagttggttgcagttccagaaattcttatgccggtctagatccaagcaaccagattggatctggttcctcgcgtcttggaacagcagcaactattaaaggagatacagacactgctaagacttctgatgatatcagtttaagtctgggccaaagttctagtctttgtaaggaaggaagtgaagaacaagatttggcagctgatcggaagctctttcgtcttgtctccaatgactccttcatctctattcagccttccttatcctcttgtggacaggacttgccaagggacttcagtgacaaagtgaacctgccaagtcataaccaccaccaccatgttgatcagtctctgtccagcgcctgtgacacagaagtagcttctcttgtacctttacactcacactcttatagaaaagaccaccggccgcgaggtgtaccacggacttctagctctgctgtggcttttccagacacttcactgaatgattttcccctttatcagcaaagacgtggattagatccagttagtgagttagaatcttccaagcctctttctggatccaaagaatccttggtggaaaattctggtttatctggggaatttcagcttgctggtgacttgaaaatcaatacttctcagccacccacaaaaagtgggaagagcaaacctttgaaagcagagaaaagcatggacagcttgaggagcctgagcacacggagtagtgggtcaacagaaagctactgcagtggaacggaccgggacactaacagtactgtcagcagctataaaagtgagcagaccagctcaactcacatagagagcatcctgtcagagcatgaggagtctcctaaagcaggaacaaaaagtgggaggaagaaagagtgctgtgcaggcccagaggagaagaatagctgtgccagtgacaaaaggactagcagtgaaaagattgctatggaagcgagtaccaacagtggggttcacgaggccaaggaccccaccccctctgatgagatgcacaaccagagaggtctcagcacctctgcatctgaagaagccaataaaaatccccatgcaaatgaatttacttcccaaggggacagaccacctgggaacactgcagaaaacaaagaagagaagagtgataagtcagctgtttctgtggattccaaagtgcgtaaagatgttggtggaaagcaaaaggaaggggatgttcgacctaaatcttctagcgtaatccatcggacagcttctgcccacaagtcaggcaggagacgcacaggaaaaaaacgggctagcagttttgattcaagccggcatagggactatgtttgctttcgaggtgtttctggtaccaagccacacagtgctatattttgtcatgacgaagactctagtgatcagagtgacttgagtagagcatcaagtgttcagtctgctcaccagttcagcagtgatagctcttctagcaccacttctcattcctgtcagtctcctgagggcagatacagtgctctaaagaccaaacacactcataaagaaaggggcacagactctgaacacacacacaaagctcatttggttcctgaaggaaccagcaaaaagcgtgcaacacgacggacttctagcacaaatagtgccaagactcgtgcccgagtgttgagcctggacagtggcacagtagcatgtttgaatgactcaaacaggttaatggcacctgaaagtataaagcccttaaccacttcaaaatcagatcttgaggccaaagagggagaggtgctagatgagctatctttattaggacgggcttcccagttagagacagtcactcgatctaggaatagcttgccaaaccaggttgcatttcctgaaggggaagagcaagatgcagtcagtggagcagcacaagccagcgaggaggcagtgtcatttcgccgtgaacgcagcacatttaggcgccaggcagtacggcgccggcacaatgcagggagtaaccctacccctcctacattgctcatcggatcacccctaagccttcaagatggtcagcaaggccagcagtccacagcccaggtcaaagtccagtcccgccccccttcccaggctgcagtgctcagtgctagtgcctccttgctggtgagaaatgggagtgtccacttagaagcatcacatgacaatgcatctgctgtaggcggtagcagtttgcacgatgaacttggtaagttctcttctacgctgtatgagactggtggctgtgatatgtcacttgtgaattttgaaccagcagcaagaagagcatccaatatctgtgacacagattctcatgtatccagttctacctcagttcgattttatccacatgatgtgctctctctcccacagattcgattgaatagactattgaccattgatacagatttgttggagcaacaggacattgatctaagccctgacttggcagctacttacggcccaacagaagaagctgcccaaaaggttaaacactattatcgcttttggatcctaccccagctgtggattggcattaactttgacagactcacacttttggccctgtttgatagaaatcgtgagatcctggaaaatgtgttagctgtcatcctggctattctcgtggcctttttgggatctattcttctcatacaaggattcttcagagatatctgggtcttccagttctgcctcgtcatagccagctgtcaatactcactgcttaagagtgttcaaccagattcttcttctcccagacatggtcataatcgtatcattgcctacagtagaccagtttatttctgcatatgttgcggtcttatttggctcttggattatggtagcagaaacctgactgcaaccaagttcaaattatatggaataactttcaccaatccactggtgtttatatcagccagggatttagttatagtgtttacactctgtttcccaatagtgtttttcattggtctcctgcctcaggtgaatacatttgtaatgtacctttgtgaacaattggatattcatatttttggtggtaatgccactacaagcctgcttgcagcactttacagttttatctgtagcattgttgcagtagccttattgtatggattatgttatggggctttaaaggattcttgggatggccagcatattccagtacttttctccattttttgtggtttattagtggcagtgtcttaccatctcagccgacaaagcagtgatccatctgtacttttctctttagtgcaatccaagatttttccaaaaacggaagagaaaaatccagaagaccctctatctgaagtaaaagatccactgcctgaaaaacttagaaattctgttagtgagcgattacagtctgacctggtagtatgcattgtaattggtgtgctgtattttgctattcatgtaagcacagtcttcacagtattgcagcctgccctcaagtatgtgttgtatacattggttggctttgtgggttttgtaacccattatgtgctgcctcaagttagaaaacagctaccatggcactgtttctctcatcctctgctaaagacactagagtataatcagtatgaagttcgaaatgcagccactatgatgtggtttgagaaacttcatgtgtggcttctttttgtggagaagaatataatctatccattgattgttctcaatgaactgagcagcagtgcagagacaattgctagtccaaagaaactgaatacagaattaggtgctttaatgatcactgttgctggtttgaagttgctacgatcctcttttagcagccctacatatcagtatgttacagtcatctttactgtgctgtttttcaaatttgactatgaagctttttcagagaccatgctgttggatctcttctttatgtccatactcttcaacaagctttgggaactactttataaattgcagtttgtgtatacctatattgccccatggcagatcacatggggttctgctttccatgcttttgctcagccttttgcagtgcctcattcagccatgctgtttattcaggctgctgtctcggccttcttctctactccactgaacccctttctgggaagtgcaatattcatcacttcatatgtccgacctgtgaaattctgggagagagactataacacaaaacgagtggatcattcaaataccagattggcttcccagcttgatagaaatccaggatcagatgacaacaatctgaattccatcttttatgagcatttaactagatccctacagcacagcctctgtggtgatttgctactaggacggtggggaaactacagtacaggggactgtttcatccttgcctctgactatctcaatgcattagtacaccttatagagataggcaatggtctggtcacttttcagctgcggggacttgaattcagaggtacctactgtcaacaacgggaagtggaggccattactgaaggtgtagaggaagatgaaggattttgctgttgtgaacctggccatattcctcacatgctttcatttaatgctgcatttagccagcgatggctagcttgggaagtgatagtcacaaagtacattctggagggttatagcatcactgataacagtgctgcttctatgcttcaagtctttgatcttcggaaagtactcaccacttactatgtcaagggtatcatttattatgttacgacctcgtctaagctagaggagtggctagctaatgagacaatgcaggaaggacttcgtctgtgtgctgatcgcaattatgtcgatgtggacccgacctttaatccaaacattgatgaagactatgaccaccgactggcaggcatatctagggagagtttctgtgtgatttacctcaactggatagagtactgctcttcccgaagagcaaagcctgtggatgtggacaaagattcatccctagtgactctctgttatggactctgtgttctgggacggagagctttggggactgcatcccatcatatgtccagtaatttagagtcattcctctatggattgcatgccctatttaaaggagatttccgtatttcttcaattcgagatgaatggatctttgctgacatggaattgctaagaaaagtagtagtccctgggatccgtatgtccattaaacttcatcaggatcattttacttctccagatgaatatgatgaccctactgtgctctatgaagccatagtatctcatgagaagaacctcgtaatagcccatgaaggggaccctgcatggcggagtgcagtacttgccaactctccctccttgcttgctctgcggcatgtcatggatgatggcaccaatgaatataaaatcatcatgctcaacagacgctacctgagcttcagggtcattaaagtgaataaggaatgtgtccgaggtctttgggcagggcaacagcaggagcttgtttttctacgtaaccgtaacccagagagaggtagcatccaaaatgcaaagcaagccctgagaaacatgataaactcatcttgtgatcaacctattggctacccaatctttgtctcacccctgacaacttcttactctgacagccacgaacagcttaaagacattcttgggggtcctatcagcttgggaaatatcaggaacttcatagtgtcaacctggcacaggcttaggaaaggttgcggagctggatgtaacagtggtggcaatattgaagattctgatactggaggtgggacttcctgcactggtaacaatgcaacaactgccaacaatccccacagcaacgtgacccagggaagcattggaaatcctgggcagggatcaggaactggactccacccacctgtcacatcttatcctccaacactaggcactagccacagctctcactctgtgcagtcgggcctggtcagacagtctcctgcccgggcctcagtagccagccagtcttcctactgctatagcagccggcattcatccctccggatgtccaccactgggtttgtgccttgtcggcgctcttctactagtcagatatcgcttcgaaacttgccatcatccatccaatcccgactgtcgatggtgaaccaaatggaaccctcaggtcagagcggcctggcctgtgtgcagcacggcctgccttcctccagcagctccagccaaagcatcccagcctgcaaacatcacactctcgtgggctttcttgcgacagagggaggtcagagcagtgccactgatgcacagccaggcaacaccttaagtcctgccaacaattcacactccagaaaggcagaagtgatttacagagtccaaattgtggatcccagtcaaattctggaagggatcaacctgtctaaaaggaaagagctacagtggcctgatgaaggaatccggttaaaagctgggagaaatagctggaaagactggagtccgcaggagggcatggaaggccatgtgattcaccgatgggtgccttgcagcagagatccaggtaccagatcccacatcgacaaggcagtgcttctggtccagattgatgataaatatgtgactgtaattgaaactggggtactagaacttggggctgaagtgtgagccagtgtttattataaagacatttctttttccctctcaattccaaggcattggaaaaagagaggaacaagcagaagatgcctgcaggtatcactttgatcctatgtgggagcgactgaaaatagaatgagcttggttaagcacctctcctttgcccttcaccctgactcctgtcactgtctccatccccaaataaagctgaaatatttttttaagttagctgccgagaaaacattttgcatgaaggataaagttctgttaaaatacatccttaaaaaaagtttttcctatgcattgcctatgctttaaatcaacaaactcttcatttctaaactatgatctcatatttttctaatttctttgccaaaaataattgccatgttttgtcatagaacatgaaattcatttaccttgatttttaagaacagaccagtgtagaaatgttccttttgacttatagcagtataaaagtttaatgtacagtgaaagagactatgaacagacatagatttatcttattccttgagcgctaaaaactttaataaaaaaaactgcactaattttttacagcaatgcactaaagtctgagatttctcagaacatttatttatatataaaaataaaataccattatttaaattgcctttgggattagccccttccctttccttataaacacaggtagcaggaactgtgctgctcatttttctgttagtagtgtgtacttcatgccaggacattgggtattttctttaaagtgaatatagaatctcaagatatacgtagcttcatcattgacatttcccagagccaatagtcagcggatcggtcttgtgaacaccactgccagctcctgtgtctacatctcagaggagcccatgtgctctgcttctctccaccagagcaagctctgctgggcgtgcttctgggaagaaaacaattttctttaagaagaagatgaatgtccaggaatttaaagaaaggatcgattgccttttatttatgagtttctagctcttgaagttattcacatgcagttcagttagtcaagtaaaattttttttcaaataaaagtatccaagtggtgcagttattattatatccctctttaataattttgctttttatttttcccctcttctttttctgttacttgaattttatttcctgtaatttatagtgtgtagctgtaaattgaaatatttataactgtgaaattgacttaattcatatgttgtctcataactttattttttttaaatgcatattcagggaaatatattactcatatttacaattgggcgatataggaacttcaatttagatttaatttgcaactcttagcattttttaaatccttgataaaattttcccttttggtgtgaaactccaaagaaaattgtacatctcctctgagcatttaggagcagccatctttctaccccttgtgaataaatcattgaaagaaacaggtaaaattaattttaatgatacattttgtttcacccagtatagtcaaagtattactatttcatcatatgtcactagccatatttcaagtactcaatagctacatgtacctagtggctactgtattagacagtacagatttaaagtatcttttgttgaggtgacagaagagagaagctgtttttcctaccaattctgatgtagatctcacattatagcataacattacagtagaaggaatgaaaactaagaaagtaaatagtgaacatacagaacttactgcatttccactttaaaacctatttattttccctttttctaattttaaacttttgtggtcattcagaacctaatgtgccttgtgttgacatttccatagacttcacactttacaaaatttactgtttaaaaatacttgtcaaatgatttactgaacctttatacaaaagtaccctttctaaattgaccatttaaaaatgtatttttgtgataccgtcattatgttctgcatttgcctcattttggcagatctacagtatgccattaaagtttagtgttgtttttggttttggagggtttttttctgaaactgaatttataatctatttctctgtatacgtatatttttaaaatcttctgaaaggaactatgttccctgctgcttcttccctttctgaagtgaatatgatcttttcatggtcattgcctagataaaagtagagccttttcaatcttagatggaagataattcattttcccacacagaaaaaaaatctgacctttacatgatttaatctgaagggctagaattttttaatttctagcccctcctccaaaaaaattttaaacacatcacatactctgaaaagtcagatttcaaatgcaagactagactttatatggaacatatatgttgggttttgattttgggtagcaattgacatatatttttctcaaaacaagttgaattttgttaacatatataattctttagtgaatttataaattaggacccctgagaagaagccctgttgtttttcttaagagtctaaaactgacaatcttttaaaaatcataatacttttctagtaattgcatcagggaattggtgataattgaagaaagatccatttcttaagaataatttgatctaaattattatatggaaataaacatacttgtgttaactaaattgatcataaattcttgttcctgcctcacccctcaccccccagagaatagtgagtgactcgtttagattctctgctttttttcagttatgtacaagacttcagcatacattaatgtctttagtttataaatttgccaatgctttaatttccataatttgaaagttaaaagatgtaactaaaatactagcttttttattcatttccttttggtggagttgtatgattgaaaactttgctttttcttgtttaattcttccgccaccccctcttttgagagaaaggtaatcgtggaatgagttataaattattgcctttttttcctttatttctttcattcagtggcaaaaaacattttataactcctaagtttttggttaatcttccaacttataccttggtgtgaactctctttttacaccattttcaacactggataaaactttaatgttgactttttgctaaagaactttaatttttccaagaatctagattaacataagatgttgatatttaaggaacttggaagagtaagtggtgaggctgtatgtatattttttaagagattaccttttaggaaattagtgaacaaacttaaccagtgttctgccttctttgactttgttactggaggatgataatctatttctattagattcgaagtattttggaaaatatttcaagtatatctgaactacttataattcttaaaacagaagtagtcagacaatatttgtatcctaagtgagatatggaaaattactctgtatactaaatgtcaggcaatgaaaatgtaagtttttgtgtagaaaacccattaagaagatgtgtttttctttctgaattagtttatttttccatcacataccaaaatataaaaatcagcctcacatttttcagcaagtttagcttatagccttgataaattcctctgtgcttctgagcagcatccttctgcctctgcttagcagctctgcatttggtggattgctgttgtgagtcattcatccagcactgggccttttaagctgaagattcacccagtgtctaaagttgtccttttcttatagctagctttcaagcatctttcctcctaaataaatatgtgacttgagaaaaaggtaataatgattttgtcagaattctttgaatttatatttactagctacttaaccataaactgctgtccgagattgttaatttcatttatatttattttaattaatttgtcatgaatatggacaaagccttttctggggtgtgtgtgtgtgtgtatgtttgttttttaagtcgtcattattcattcgtattctttttctgtgtaatgtaatcatataaagttactttggacagagacccagttaattttctcttttgataggatacatggtttagataaggtataaagtgtccctttttattctagaggcttttcctttaattcagagattagtggagataataacgtcagtcaaggctaatgtggtacatggaacttgctaatggaggttggacattctgtttcagtcttacatggatattgtttcattggtgttgaggaagaaaaaaattagatactaccatgcattgggacagcataattctaatattacattgaatatggctttttaaaaataagtattaaaaagccaatcgttttctccatttatctatcttttttgtttgtttttaatttggttgattgatatgcacccaggccgtcttatttttacttgttaaatgtctgtctaggaagaactgtgattggaaaggaattaattattatacaaataaatctggtaggatatgagtggagtaagtttgcttgaaacagaagtatattttctactttgaatcacctcaccagagtcatctgtcaagaattatgtataacaatttatctttattgcctacatacaacatactttttctgaattaagataacttctatttgtgagttgaacttcattatctgccattttgtggaatcaaccttacattctttggtggaactagagctgattgtcaccacaaggttatatgacaactctgttctaagacttatacctattatatagggttataccttttttcttatgcctcagctctgtacctgacaatttatgattcagtggagccaagctagaaggaacaaaggtcatctaacactgtgatggggatgaattcctgagttttacctgcacaatgaggtggtgccccggaattcacaacagagtagtgatagagcataagatggctgctccagatgactcttgggtttagtgtacttgtgattgaacaagattttttatctatgaagcttgattctacaaccaaaataatagaaatggggggggggggggaatcatgtctgcttatgctttttaaaagcttatagtttaagtaaaagtaaaatgtaaaaactgattaaacctatacaagtctggcaatgagctctgcatgaggaaatggaaggaggaatattgaaaatgattctaggaaagtgaacgtaagaaaggaaaatgggttttccttttctgatcatgggctctggaaagtattcatggcctttaccagcattcagtataaaccagagataaggacatatgtacttacgtgtgtctgtgagtgtgtgtgtgtctgagtgttattctgaacagcttgtaaatattgtagttgtttaaaatggaaaataaaagctgagttcttttggcaaatatattgcatcaaaaatacag

SEQ ID NO: 453457 - DNA, 2307 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453458 - DNA, 2333 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaatatgtattggccctttttttgcaaacc

SEQ ID NO: 453459 - DNA, 2253 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagatatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453460 - DNA, 2286 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453461 - DNA, 693 bp, Homo sapiens
gctttgccagtacatttgcagcgtcttcaatccctgagtggagagagaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453462 - DNA, 831 bp, Homo sapiens
aaccctgtctctactaaaaatacataaacttagccgggtgtgctggcacgtgcctgtagttccagctacttgggaggcagaggcaggagaatcgcttgaacccaggaggtggaggttgcagtgagccgagatcgcgccactgcactccagcctgggcgacagagcaagactccatctcgtctcttctctacaagagaagagacgagatgtacaaggaagagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453463 - DNA, 1845 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctctgagacccatgtctaatgcccaagggtggagttcttgatcctgggataagaagggtgtgaagtggagactgcggtgatgatgcgttgcctgcctgggctatgaactggatgtggatgagcggctggaaccggtagcggcgacttcgagggcggccagggagggccgtgtgcaacgtggggaggttatggcgcggggaagtgggtcgcgagagggcgtggggagggccggttggtggggg

SEQ ID NO: 453464 - DNA, 2401 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaataaaaaaaaaaaaaaaaaaaaaaaaaaaaaaaaaaaaaaaaaaaaaaaaaaaaccagaaagaaagaaagaaaataaagaaagaaagaaagagaaa

SEQ ID NO: 453465 - DNA, 2237 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggtgatggaatgataaaagtgaagaatcagctccgcttccttgcagaactggcctatgatctggatgtggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453466 - DNA, 2239 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctctggatgatgcgcctggaaacagtcagcaggcaactccgaaggacaacgagataagcacctttcacaacctcgggaacgttcattccccgctgaagcttctcaccagcatggccatctcggtggtgtgcttcttcttcctggtgcactgactgcctggtgcccagcacatgtgctgccctacagcaccctgtggtcttcctcgataaagggaaccactttcttatttttttctatttttttttttttgttatcctgtatacctcctccagccatgaagtagaggactaaccatgtgttatgttttcgaaaatcaaatggtatcttttggaggaagatacattttagtggtagcatatagattgtccttttgcaaagaaagaaaaaaaaccatcaagttgtgccaaattattctcctatgtttggctgctagaacatggttaccatgtctttctctctcactccctccctttctatcgttctctctttgcatggatttctttgaaaaaaaataaattgctcaaat

SEQ ID NO: 453467 - DNA, 1788 bp, Homo sapiens
ccctgccccgcgccgccaagcggttcccgccctcgcccagcgcccaggtagctgcgaggaaacttttgcagcggctgggtagcagcacgtctcttgctcctcagggccactgccaggcttgccgagtcctgggactgctctcgctccggctgccactctcccgcgctctcctagctccctgcgaagcaggatggccgggaccgtgcgcaccgcgtgcttggtggtggcgatgctgctcagcttggacttcccgggacaggcgcagcccccgccgccgccgccggacgccacctgtcaccaagtccgctccttcttccagagactgcagcccggactcaagtgggtgccagaaactcccgtgccaggatcagatttgcaagtatgtctccctaagggcccaacatgctgctcaagaaagatggaagaaaaataccaactaacagcacgattgaacatggaacagctgcttcagtctgcaagtatggagctcaagttcttaattattcagaatgctgcggttttccaagaggcctttgaaattgttgttcgccatgccaagaactacaccaatgccatgttcaagaacaactacccaagcctgactccacaagcttttgagtttgtgggtgaatttttcacagatgtgtctctctacatcttgggttctgacatcaatgtagatgacatggtcaatgaattgtttgacagcctgtttccagtcatctatacccagctaatgaacccaggcctgcctgattcagccttggacatcaatgagtgcctccgaggagcaagacgtgacctgaaagtatttgggaatttccccaagcttattatgacccaggtttccaagtcactgcaagtcactaggatcttccttcaggctctgaatcttggaattgaagtgatcaacacaactgatcacctgaagttcagtaaggactgtggccgaatgctcaccagaatgtggtactgctcttactgccagggactgatgatggttaaaccctgtggcggttactgcaatgtggtcatgcaaggctgtatggcaggtgtggtggagattgacaagtactggagagaatacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagaaaccttatccagccgaagaagggaactaattcagaagttgaagtctttcatcagcttctatagtgctttgcctggctacatctgcagccatagccctgtggcggaaaacgacaccctttgctggaatggacaagaactcgtggagagatacagccaaaaggcagcaaggaatggaatgaaaaaccagttcaatctccatgagctgaaaatgaagggccctgagccagtggtcagtcaaattattgacaaactgaagcacattaaccagctcctgagaaccatgtctatgcccaaaggtagagttctggataaaaacctggatgaggaagggtttgaaagtggagactgcggtgatgatgaagatgagtgcattggaggctcatttaacttttttaatgggtctcaaaattctgtgacaaatttttggtcaagttgtttccattaaaaagtact

SEQ ID NO: 453468 - DNA, 1414 bp, Homo sapiens
ggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaacaaaactgtcttatctccaagtaatcatatctcctgcta

SEQ ID NO: 453469 - DNA, 2443 bp, Homo sapiens
ggaagaggttgcagtgagccaagactgagccactgcactccagcatgggtgacagagaaaactctgtctcaaacaaaaaaataataaaatttattcagtaggctggattctacacaaagtaatctgtatttgggccatgatttaagcacatctgaaggtatatcactcttttcaggctataattatttgggtaatcttcattctgagacaaacttaatctatatcatttactttgcaacagaacaaccctacagcattttggttcccagactaagggaactaatatctatataattaaacttgttcatttatcattcatgaaatataaaatacttgtcatttaaaccgtttaaaaatgtggtagcataatgtcaccccaaaaagcattcagaaagcaatgtaactgtgaagaccagggtttaaaggtaattcatttatagtttataactccttagatgtttgatgttgaaaactgctttaacatgaaaattatcttcctctgctctgtgtgaacaatagcttttaatttaagattgctcactactgtactagactactggtaggtttttttggggggggtgggtagggatatgtgggtaatgaagcatttacttacaggctatcatactctgaggccaattttatctccaaagcaataatatcattaagtgattcacttcatagaaggctaagtttctctaggacagatagaaaacatgaattttgaaatatatagaacagtagttaaaatactatatatttcaaccctggctggtagattgcttattttactatcagaaactaaaagatagatttttacccaaacagaagtatctgtaatttttataattcatcaattctggaatgctatatataatatttaaaagactttttaaatgtgtttaatttcatcatcgtaaaaagggatcatctcagagagaacagcagtattctgcgtatttttaaaaatgctctagagtaacatttgaagtaattcactgtagtgtatgccagtcctagaaataatttttttaatttctggtgtctgtttctaatacactaaccaagttttcaaaatatatttacaaagatgcatctttacccattattttaaaatgattaaggaggatagttgcttcaggtaacaagctaatttttcaaatattaggcccttacagaactatttagtcaaaaagtaagatattcctttaaaatatataacccaaagctttcagttaaacatgatatatcacaaatactattaaaatgttaaagagaaatgcaaatagcattaaatgatgaccaaaatgtaaaatattgtagatttcaaaagctgtgtctctattaggtgggataccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataatatttatgtacttgtgtctgaaaagttgtaaaatgcttacctcagctatacaatatctgtgactctga

SEQ ID NO: 453470 - DNA, 1145 bp, Homo sapiens
tgcgtataatggctgttacctaatggctgttacataaatggtacctaacatggctgtaccaaatgtaaatgatgtaactgacgttgttttttactttttactttttaaaaaagactaaaaacgttttgatattatacaatgtatttgtttcagataaggtcattgtcatttagtatatataattaatatatgtacaagtttaagtaaattcctgtgagtaaaaatggacttatcacaaaacatagttctaaagaaaggtatatgctcatatacacggtgtccattaatttaatgggaactaggtataacttcaggagaatttggcaaataattcattaatccatgtaaatattcaaaagcttgttctatccacattatttcaagggatcactttatttttcattatactttcacagcacttttctagtaaattctgtaacacagaaattccattttggaatcatttcatgttaccaataattctagacttttataacatttaacatgttgatggaaatagattacatctgctagaaccttttgccttaactattcaccaatatatgctaatattcataaatatggattgactgtttacaaacattagaatcttgtcttggttccattttgatggctaatatttgttatcttaattaagactatttctgaggtcatgattacttgaaaatattgactaaaactgggtccttagaaattccaggtggagctgatttacctatgactgaggggaaaaaaaaatcaaattttactgataatagtaatgctccaaatgaattaatgacacatctgttcaataaataaagagcttaaatatacaaaacataagaaatctgggcaacaaaacttgtggtctttacttttgaatagctacccaagaaaaggttttaaaggtaaaagttatgagtaatgtcatcacaataagctcttgtttaaaattcttttcttttatgtataattaggtttatgtttcatgtctttttaaaaccttataaaagatttaattatcacatctattcttcaatgtggaaatattaaatattgttggttgtaaaataatatttatgtacttgtgtctgaaaagttgtaaaatgcttacctcagctatacaatatctgtgactctga

SEQ ID NO: 453471 - DNA, 1441 bp, Homo sapiens
agctaaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 453472 - DNA, 2620 bp, Homo sapiens
agctaaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccaggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 453473 - DNA, 3011 bp, Homo sapiens
agctaaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccaggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctggggggcctcacacagcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgcaaaaaaaaaaaaaaaaaaagaaaaaaaaaaaaagaagaaaaatagaaaacaaaaaaagaaaaaaaaaaaaaaagagaaaaaaaaaaaaagaaaacagaaaaaaacaggggggggggcaaaaaaaatacggaacggcggggggagaggagcccagagaagaaagccgaaacagcacgcgggtcgttgaggaagaaaagacgggcgcacccgactaagagggacgatatattcaaaaacctgaccaagagggggggggcgcacaatacaaagcaagaacgcgagttggagaagaaacaaaacgcgtcagatactggcacacaaatgagagagcgagcgacacaaaacaagggagggggcgaggagcaacaagacggagcacggacatacagcaa

SEQ ID NO: 453474 - DNA, 2742 bp, Homo sapiens
agctaaaaatcgaggcggggctgagaggctgcggcggctgactaggttttcggaccgcggcgcggcggggaagagagactgcggcgggagggccaggccgtgggagagacgcgggaaagtgcgggtcgcagaggcacttgaccaccccgccctaggccgacccggcggacgcggcgtctggtgtgcgggcgctggggcgggtcccaggtctccccgctgcgctgcttgaggctcagccatggcccagcagagagccctgccccagagcaaggagacgctgctgcagtcctacaacaagcggctgaaggacgacattaagtccatcatggacaacttcaccgagatcatcaagaccgccaagattgaggacgagacgcaggtgtcacgggccactcagggtgaacaggacaattacgagatgcatgtgcgagccgccaacatcgtccgagccggcgagtccctgatgaagctggtgtccgacctcaagcagttcctgatcctcaatgacttcccctccgtgaacgaggccattgaccagcgcaaccagcagctgcgcacactgcaggaggagtgcgaccggaagctcatcacgctgcgagacgagatctccattgacctctacgagctggaggaggagtattactcgtccaggtataaatagcgctggactccccatgcagagcgggagcctgcctacctgggcctggccagcaggcagggctgccttctgctttttcaaattcttgctggtcttagcagtggagccatgcctgggtttcagagcagagctcctggccagagcgtttgaccgacagacaattcacatccatatgccaggccctgggcctttcccacagtgcaatgtgatgaaaaccacaggactcacgccagtcggataggccgagtctggagaagggaggcgcctggctgtatcccccgcaggccctcttccgagagccttcctcctcgggcagtgcgttctggggctgtgctgctcctgttaccttctgaatccatatgtagagatttcagccaaggctgggccagccttttttgggcagtcaggtccacacctatgtccagggcaccagggatgcaattccatgtggatgtcaccaaaccccagtgtggaggcagggacagtcatgggaatgtgggggatgaagcccaggcagggaaatggccttgaaagccattggagctccaattcgtgacccactcagccttatccacggagctggagccaacctacgtgccaggccccgtgctgggtcccagggatgcagaagggtcaaaacccatcatcctgacccttgtggggctccgtaagaagcctgaaaccttcgaccgtttgagctggaggggccctgagaaatcagagtctacgtatcatttacttagggggaaacttaggctggagacagggaggccttccactctgccccattagcttagaaaatcaagattcagtccagcagatgcagagtccatgtccatcttgtgccttctcctggacaaacctttccttcctggtggtggatttaaaatactcctttctgcccattggccatgctgggagccacagatatccagagccagcatgacctggggcttggtttccctgccctgggctcagtggcactgctgagctgcagcagtcctagagttttccagggggttctgagggaatctttggtccccagtactcattaactcagcagacatgaggcagcatttcctccacactagggtggctgagaggggtcctggggtgtttcagacccttctgggcatctccttccacagctgttcagtttgtcggtctctttgaggcagccaccgtccctgagggcccctgcacagagcagctgtgggcctgtaattcagcctgcctgccttgccttggggcagggagagagggaacctgctcacggccctgcagcagagcagggcgcaaacccaggacatctgtgccaggcttcccatgccctcccccaacagtccctcagcttcacccagcggggcttccaggccagcctgtgtcccctcccgcaggcctcctgtccacaccagcgccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 453475 - DNA, 1630 bp, Homo sapiens
gcctctgtgctcgcctgccccctctctgcttgttagttgctctttctggctctgcctctcctttgctttcctcgggatgccactctgtgcccaggacggttctgagactgaacactgagggcaggagcaagggaggaagccaggggcgaggcaggccgcgggaaagccaggcccctgcctgcaggttagaaagaggcgagcgtggattgtcacagctgcgggcatgggaagggctagctgagctcttcacctgcatcctggctgccgtgaggattccccgtgttagaggtggggacgcctgctggaggccgcctggctgatgtagggctatcgggaagtgccagggcctgtgttcccaactgtcgcccccttcaggctaagtctcaggcagggacagacccagaaagaacacagtctgccctcagagagctctttgcagtgtagtgacactggggtttctgcagtcagggaggagggagggtggccaggctgacagctttttgcaagaggagggggaccagcaccagctgggaggcataggctaggacaggcccacgtggaggctgggcaggaagggcctgctgaggtcacacagctgttggtggttgggccagggcggcttcctcctttcagaatgctagggtggctctcaccactggccgcctctccttgccaggcctgccaactcaggggacagatggagcaggagtggagaaagggaaaggcaggtctggggtgtggtcgtgttttcttaactctgcttctgtcttgctctcccctcccctggctttcctctctgcctgctcctgtctctccctggggtttctggtggtggaaaagctcaagcctttgcgaagctaatgacctgcctctgtgcgaagcttacgggaggctggacctcgacacagactctgctgatggcctctcggcccctctgctggcgtccccggagcccagtgctggccccctacaggtggcagcccctgcccactcccatgctggtggccctggccccactgagcacgcctgagcctccggggccacgcttcgttctcaggaacaaaacctgaggcagccctttggatgccctcacagccttgcttctctcagcctaggttcccatttggggacttcaggaccccagagccactaggacttccttgggaagcccgttagcccagggtgggtcccgccaggacagtagggaaacagttgtttccctagccatttccgaatagcccatcattccgagtcatcatctctgtttgctgccttcctggccagccaggtggaagaaagtttccaagctaggtctggcccgttggggatctcagcagtggggcaggagggtgcctgatttcggggagtcctgacccgagcctgttgtcagagttgggaggggctctgagcagtgttgggcaggccgggtctcccatcccgaggccagcgttcctgtgcagagccccatccactggttcttgccctgagccacatatgtctgtgccatgggctgagtgccacgacaggcccgtgtgacagctgctgcccacgcatgtggaagctaggtgggactcattcctaattctgccgttgtaatgagacttgattaaaacaccgccacttttttgca

SEQ ID NO: 453476 - DNA, 4665 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453477 - DNA, 6965 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 453478 - DNA, 10308 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453479 - DNA, 11309 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453480 - DNA, 10362 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453481 - DNA, 11118 bp, Homo sapiens
caagaacggtcttaactgaaccctcatcagatctgaatttaacaaatgcttagtctcagcagcctccgccggaattccggccggaattccggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453482 - DNA, 9950 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453483 - DNA, 10254 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttattttcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453484 - DNA, 10494 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggc

SEQ ID NO: 453485 - DNA, 10487 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctacaaaaaaaaaaaaaaaacaaaaacaagcgggggccgcctaaattcgcgaagaacaacgcgtcccactacagaacgaaggccaaaaatacacaaaaaaaacgcaaaaaagggacacaaagacaaaccaggagccaaaagaaaatgggacacacaaggaaaacatctgaaccacttaataga

SEQ ID NO: 453486 - DNA, 4409 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453487 - DNA, 8421 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagtttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453488 - DNA, 10581 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattcagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453489 - DNA, 10254 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453490 - DNA, 6695 bp, Homo sapiens
agagagagagagagagagagagagagagagagagagagagagagagagagagagagaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453491 - DNA, 6409 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453492 - DNA, 4355 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaatggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453493 - DNA, 4709 bp, Homo sapiens
gggtctatgtattcatttctcagtcagcagatgggctgggagtttcatccctcccatctactccatgtgttctgctcctttactctttactgggtgtctatgtcttgttgtggggggaggagaaaaagagaggacagacggagaataaggtggagagctgacagaactccaaccgtctctcaagtggcatcgataaacaccggtgtttatcgatgccacttcgtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453494 - DNA, 7140 bp, Homo sapiens
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaaaaaaaaagaacaacacaccacacacatacaatcacacaacaaccacacacacacaacacatacacacaacacacaccccccacacccacaacacaacaaaacactaacacaccacaccaaacacaaaaaaacagggggcggggcgccaaaaacaaccaaagcagccgacacaatcaccaacccatgatatgtatacgaggacgccaccactagcgagtataaatccgagcgcgggagtacaaacaaacagcaggagaaagactaccacgcatagtaatgaaaaaccccccatctggggcgaggcacagaccacacaaataatgtcccacgacacactacttgtgtaacggctcgctgagctgatgggatcacaaccacactctacacactccacgccccacacgcctaaccgaccacgactagcacatagagatacacctacagaacaccagaaccgagcgacgaaaaagaacaaagagacagt

SEQ ID NO: 453495 - DNA, 2421 bp, Homo sapiens
agagagagagagagagagagagagagagagagagagagagagagagagagagagagtttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453496 - DNA, 1326 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccgccgcatgaaaaagagcctctcagcccccttgcacccggaatttgaagaggtctacagattcggggcagagagcaggaaactccttttgcgggaaccagtggatgctatgcccaaccgcatcacccgtt

SEQ ID NO: 453497 - DNA, 374 bp, Homo sapiens
tggcctcgtttagacttggaaaaattagatgaactaacaagtccatattataccggttaggaaggagctcgggctttgaagttaatttaataagatatgttatttgattcgtataaaaattggtttgtagtagaaattaattaaggctatagtcttgtttaaacatgggcttaatccagagaatgatagaataggccaggagctccttatttgagttttaatgctttatcaatgaaaccctcccctgccctctcttttttcctctggactagcaagaatattttttttgtctaacacatttaaaatttttacttttaacagaaattagcagagtacggaaagacatgtacaatgacacattaaatggcagtaca

SEQ ID NO: 453498 - DNA, 7912 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 453499 - DNA, 5686 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 453500 - DNA, 4218 bp, Homo sapiens
caagaacggtcttaactgaaccctcatcagatctgaatttaacaaatgcttagtctcagcagcctccgccggaattccggccggaattccggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453501 - DNA, 8176 bp, Homo sapiens
  misc_feature (8132)..(8132): n is a, c, g, or t
  misc_feature (8141)..(8141): n is a, c, g, or t
  misc_feature (8155)..(8155): n is a, c, g, or t
ccgggggcttctcagttttattttatcaatctatatgcatatccttatgccagtctcacacagtgttaattactgtagctttgtagtcagttttgaaatcaagaagtatgagtccttcgttcttatttttcaaaattatcttggctgttctgtgtcccgtgtgtttctagataaattttaggatcatcttgtcaatttctggggatattggctgggttcttggtttacttccatgtgttctctttaaatggctagactgggctttggttttttcagtatcgggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattaacaattncccaaaaanatctatcttccatngtcgggcgttaaaattttata

SEQ ID NO: 453502 - DNA, 1653 bp, Homo sapiens
  misc_feature (1570)..(1570): n is a, c, g, or t
  misc_feature (1578)..(1578): n is a, c, g, or t
  misc_feature (1583)..(1583): n is a, c, g, or t
  misc_feature (1590)..(1590): n is a, c, g, or t
  misc_feature (1602)..(1602): n is a, c, g, or t
  misc_feature (1640)..(1640): n is a, c, g, or t
  misc_feature (1648)..(1648): n is a, c, g, or t
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgaggccggccancgggaaanttaanctttggnacttttggaacnttggaaattttttaacccatggatgggactgggaacangggctggnctggt

SEQ ID NO: 453503 - DNA, 1034 bp, Homo sapiens
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcagcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggatgctaaatagagctagcccattgcgagcataatgaagattacatcgtattatcctctgaaagtaggtaccgctca

SEQ ID NO: 453504 - DNA, 10117 bp, Homo sapiens
caagaacggtcttaactgaaccctcatcagatctgaatttaacaaatgcttagtctcagcagcctccgccggaattccggccggaattccggcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagcttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaaccttgtttggcccagagtttatgttgaaccaaatggttcatagaattttgaatttctttagattcatttctgttaatcatcagttattaataatcacatccatcattaatagttgctttaatgcttgcatcttagagaatactaatgcttaatagcagtcagatactgataactgcactgactgtttaaaaattctgtataccaaacctattcattgttgtttttcaatttccttcattgactgctactaactattagttgttagttgtattttatttctattttttcttgttaaccagtttttttctttttcattgggggagtgggctcttcttcatttgttcaaatcatgatacgaaattgtcatgattttaattgtattctgtagatggtgtcaatcagtttgtcagaattaaacatgcttttttttttattagttgtgattagtttttcatgttgtcattaagccgtcactagctgaaactaatctcttctctatcttttcttttcttttttttgttttgtttttttttgtttctaaccacccagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggaccccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccacctac

SEQ ID NO: 453505 - DNA, 1421 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagagagatgaagtctcgctctgtcaccaggctggagtgcagtggcgtgatcttggctcactgcaacctctgcctccgggttcaagcaattctcctgcttcagcctcccgagtagcttgggactacagacgcgcgcaaccatgcccagctaattctttttttctttattttattttatttttttttttgagatggagtctcgctctgtcgcccaggctggagtgtagtggcgcgatcttggctcactgcaagctctgcctcccgggttcacgccattctcctgcctcagcttcctgagtagctgggactgcaggtgcctgccaccacgtccagctaattttttatgtttagtagagatggggtttcaccatcttggccaggctggtctcgaactcctgaccttgcgatccacccacctcggcctcccaaagtgctgggattacaggcgtgagccaccgtgcctggccagtacccagtagtttttttggctcctctccctcctcccacccttcaccctcaggtagggcccagtgtctgttgttcccttctttgtgtttatgagttctcatcatttagctcccacttataagtgagaacgtgtggtgtttggttttctgttcctttcttagtttgctgaggataatggcctcaagatccatctgtgttcctacaaaagagatgatcttgttcttttttatgattgcacatcttttgttctaacgtttggtccttcaccttggttcctgacacaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttgtatcctttaaaatatcctttgtaataaatcagcaatagtaagtaaactattttc

SEQ ID NO: 453506 - DNA, 2061 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagagagatgaagtctcgctctgtcaccaggctggagtgcagtggcgtgatcttggctcactgcaacctctgcctccgggttcaagcaattctcctgcttcagcctcccgagtagcttgggactacagactagagacggggtttcactgtgttagccaggatggtctcgatcccctgacatcgtgatccgctgtcctcggtctcccaaagtgctgggattacaggcgtgagccaccgcacctggtcgattaacctcttttaagcctgttttctcatccatacaatggagataatggcagcacccactgcttgactgggcaacaagagcgaaactccatctcaaaaggaaaaaaaagcaaaagagaaaaaacccaaacaaacaaaacccctgaacttccctgcgggcacattttctctggcagcctttttcaatgagagctatgttttctccgatactatatggcctgcggaccgctcagctttcattccagtgaaaacattccagaacaaactccaggtcggtcccaggtgtttctccaatcaactcagggcatggttgtgtgtcacctgctgcccagctagaatgacacctctccaggcctctgacttagctaggtctccaccatgtgactccaccgtagactccatgccttcttcttttgcaaagcctcggacacccaaacacctaccaaaagtgggtagggtgccaggacacctccaagtataagtagggctccccaccatgcctggatttggagttgtgctgcagagtggtggctgctcatgacattcatttcacccctttctgtgcaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtggtaaagtagcctgaaagccagtggtacaaccccctccccacaaccttcaccacctctagcccctccaatgaaaagcactaattgcctatatacaacccctttttgtttgaaatatctagagtaatttctgttttcctatctggggtagtgtaacgtaagaagaaatatacatttggtctctgcccccggttcctaacacaaagctcctaaaacccttggaaattcctgaaagatgggggtgctaggagcattgtctttttttttttttaaatttatcatttttcttttctcccaggtgttttttccttttttttttttttaacttttattttagattaggggatacatgtgaacgtttgttatatagctaaacttgtgtcacatgggtttgttgtacagattatttcgtcacccaggcactaggcctaatacccgatagtttttttctttttttttttttgagactagagcgagactccatctcaataaaaaaaataaagtgaattttcctccatcttgtaagggcgaaaagccccctaccatgtctgaatgaacattcatgcatgggcttgagggcttgggaaaaagacagggcttggccacacagtgcaggtaggcccagtgatcctatgagaggggccaggaggtggtaggtcccctgtgggcaggaggtcaagtatgtggtattatacttgatgaaccaggggagaggg

SEQ ID NO: 453507 - DNA, 1745 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagagagatgaagtctcgctctgtcaccaggctggagtgcagtggcgtgatcttggctcactgcaacctctgcctccgggttcaagcaattctcctgcttcagcctcccgagtagcttgggactacagacgcgcgcaaccatgcccagctaattctttttttctttattttattttatttttttttttgagatggagtctcgctctgtcgcccaggctggagtgtagtggcgcgatcttggctcactgcaagctctgcctcccgggttcacgccattctcctgcctcagcttcctgagtagctgggactgcaggtgcctgccaccacgtccagctaattttttatgtttagtagagatggggtttcaccatcttggccaggctggtctcgaactcctgaccttgcgatccacccacctcggcctcccaaagtgctgggattacaggcgtgagccaccgtgcctggccagtacccagtagtttttttggctcctctccctcctcccacccttcaccctcaggtagggcccagtgtctgttgttcccttctttgtgtttatgagttctcatcatttagctcccacttataagtgagaacgtgtggtgtttggttttctgttcctttcttagtttgctgaggataatggcctcaagatccatctgtgttcctacaaaagagatgatcttgttcttttttatgattgcacatcttttgttctaacgtttggtccttcaccttggttcctgacacaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttagcagctccgagggcaggcatggtggctcatgcctgtagtcccagcactttgggaggccgaggcaggtggttcatctaaggtctggagttcgagaccagcctggccaacatagcgagagcagctccggtggcgggaggagtggcagcggccaggcagcccagcttcgcgaaggctgtaggcacaccgcggccagcaggcacctggcacccaccttccctgctgccaggatgcccaagaaaaaggtcagctccaccgaaggggctgccatggaagagcccaagaggagatcagcgcaattgtcagctaaacctcctgcaaaagtggaagcgaagccgaaaaaggcagcagcgaaggataaattttcagacacaaaagtgc

SEQ ID NO: 453508 - DNA, 1253 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtggtaaagtagcctgaaagccagtggtacaaccccctccccacaaccttcaccacctctagcccctccaatgaaaagcactaattgcctatatacaacccctttttgtttgaaatatctagagtaatttctgttttcctatctggggtagtgtaacgtaagaagaaatatacatttggtctctgcccccggttcctaacacaaagctcctaaaacccttggaaattcctgaaagatgggggtgctaggagcattgtctttttttttttttaaatttatcatttttcttttctcccaggtgttttttccttttttttttttttaacttttattttagattaggggatacatgtgaacgtttgttatatagctaaacttgtgtcacatgggtttgttgtacagattatttcgtcacccaggcactaggcctaatacccgatagtttttttctttttttttttttgagactagagcgagactccatctcaataaaaaaaataaagtgaattttcctccatcttgtaagggcgaaaagccccctaccatgtctgaatgaacattcatgcatgggcttgagggcttgggaaaaagacagggcttggccacacagtgcaggtaggcccagtgatcctatgagaggggccaggaggtggtaggtcccctgtgggcaggaggtcaagtatgtggtattatacttgatgaaccaggggagaggg

SEQ ID NO: 453509 - DNA, 942 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtgaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttgtatcctttaaaatatcctttgtaataaatcagcaatagtaagtaaactattttc

SEQ ID NO: 453510 - DNA, 1009 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaatcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtgtttgctgaggataatggcctcaagatccatctgtgttcctacaaaagagatgatcttgttcttttttatgattgcacatcttttgttctaacgtttggtccttcaccttggttcctgacacaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttgtatcctttaaaatatcctttgtaataaatcagcaatagtaagtaaactattttc

SEQ ID NO: 453511 - DNA, 731 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtggacatggagagctgctgggttggcgaacacatccatgtgccgggaggatggtgcaccccaactccacaaggacccttccagacctcaccctgtgtatctcttcatctggctgttcatttggctcagtcctttggatgttaatccacctgggctggtgcacctaaataataaagatcctcctcaatcccaaa

SEQ ID NO: 453512 - DNA, 1346 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagagagatgaagtctcgctctgtcaccaggctggagtgcagtggcgtgatcttggctcactgcaacctctgcctccgggttcaagcaattctcctgcttcagcctcccgagtagcttgggactacagactagagacggggtttcactgtgttagccaggatggtctcgatcccctgacatcgtgatccgctgtcctcggtctcccaaagtgctgggattacaggcgtgagccaccgcacctggtcgattaacctcttttaagcctgttttctcatccatacaatggagataatggcagcacccactgcttggtaaggaatattaggtgaacacaggtgcctatgtgggttcctccattttccataaatgttaattcccttatccctcatctcctaggttagtcccagaggacagatttgaagttgaaaacagaaagtaactgccaaaagggattatttagggcagagattgtccccttttattatgctttaggtcctcagtggtgagggcaggggacaggagaagtgggatccagcccaaattcttggatctcatcgtagagtgactctttaggggcttaggattctgcattttggacccgtccccagggcattctgatgcctgcagttctcctgtctggctttgaataactctgggtagtgctttaaatctaagctgacataccagtgggatgtgaactgtccttgcaaatgttttgagcccttcctgcgctggcctccaactctgccttgctcagtctgtctttagctcctttccattctggccttctccctttcctttttcacttccttttttttttttttggagacaggatctcactctgttacccaggctggagtgcagtggcatgatcttcgctcactgcaagctccgcctcccgggttcaagcaattatcataccttagcctcctgagtagctgggactacaggcgcacaccaccacacccagctaatttttgtagttttagtagagatggggtttcaccatgttggccaggctggtctcaaactcctgacctcaagtgatccgcctgcctcggacactcaaagtgcta

SEQ ID NO: 453513 - DNA, 1080 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtgtttgctgaggataatggcctcaagatccatctgtgttcctacaaaagagatgatcttgttcttttttatgattgcacatcttttgttctaacgtttggtccttcaccttggttcctgacacaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttggctcagtcctttggatgttaatccacctgggctggtgcacctaaataataaagatcctcctcaatcccaaa

SEQ ID NO: 453514 - DNA, 740 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtggacatggagagctgctgggttggcgaacacatccatgtgccgggaggatggtgcaccccaactccacaaggacccttccagacctcaccctgtgtatctcttcatctggctgttcatttcacctcgctgctatctcaaaggttgggattacaggtgtgagcccctgtgcatcaccctcaaacttatgctagctctactcg

SEQ ID NO: 453515 - DNA, 1435 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagagtagagacggggtttcactgtgttagccaggatggtctcgatcccctgacatcgtgatccgctgtcctcggtctcccaaagtgctgggattacaggcgtgagccaccgcacctggtcgattaacctcttttaagcctgttttctcatccatacaatggagataatggcagcacccactgcttggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtggtaaagtagcctgaaagccagtggtacaaccccctccccacaaccttcaccacctctagcccctccaatgaaaagcactaattgcctatatacaacccctttttgtttgaaatatctagagtaatttctgttttcctatctggggtagtgtaacgtaagaagaaatatacatttggtctctgcccccggttcctaacacaaagctcctaaaacccttggaaattcctgaaagatgggggtgctaggagcattgtctttttttttttttaaatttatcatttttcttttctcccaggtgttttttccttttttttttttttaacttttattttagattaggggatacatgtgaacgtttgttatatagctaaacttgtgtcacatgggtttgttgtacagattatttcgtcacccaggcactaggcctaatacccgatagtttttttctttttttttttttgagactagagcgagactccatctcaataaaaaaaataaagtgaattttcctccatcttgtaagggcgaaaagccccctaccatgtctgaatgaacattcatgcatgggcttgagggcttgggaaaaagacagggcttggccacacagtgcaggtaggcccagtgatcctatgagaggggccaggaggtggtaggtcccctgtgggcaggaggtcaagtatgtggtattatacttgatgaaccaggggagaggg

SEQ ID NO: 453516 - DNA, 1387 bp, Homo sapiens
tgacgtaaaaggaaagagacggaagaggaagaattctacctgagtttgccataaagtgcctgccctctagcctctactcttccagttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagaggtgctggaagcccaggaagcacacatcaaggctcccttgccagcagggtgctgccaataaaaggtagtcacgtggaatttggaatgtggaaaggaggtagaagtcatcctttcctcccctgtagcagcaggcgtgcaggctctggtggtcagctggactccatactcccccaccagtcaccagcctggggaccgtggggctgcaaggacctcagcagcggtgtcccaagtttcctgacttcttccatcctctggaaatcagctgtgtttgctgaggataatggcctcaagatccatctgtgttcctacaaaagagatgatcttgttcttttttatgattgcacatcttttgttctaacgtttggtccttcaccttggttcctgacacaaggattcctaaatcccttggaattttctgcatgataggagcgtcctttgttctcatgaggtgactcttggtgggctccttatttggggactggtcaccaaaaatacctaactatggttggaagcttagtgctttcagccccattccccatcctctggggtggggagcagagctggagctcgatcatgcctgcgtgacaaagcctccagaaaaatccttgaaagacaggacatggagagctgctgggttggcgaacacatccatgtgccgggaggatggtgcaccccaactccacaaggacccttccagacctcaccctgtgtatctcttcatctggctgttcatttagcagctccgagggcaggcatggtggctcatgcctgtagtcccagcactttgggaggccgaggcaggtggttcatctaaggtctggagttcgagaccagcctggccaacatagcgagagcagctccggtggcgggaggagtggcagcggccaggcagcccagcttcgcgaaggctgtaggcacaccgcggccagcaggcacctggcacccaccttccctgctgccaggatgcccaagaaaaaggtcagctccaccgaaggggctgccatggaagagcccaagaggagatcagcgcaattgtcagctaaacctcctgcaaaagtggaagcgaagccgaaaaaggcagcagcgaaggataaattttcagacacaaaagtgc

SEQ ID NO: 453517 - DNA, 2029 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataa

SEQ ID NO: 453518 - DNA, 688 bp, Homo sapiens
tacctagttcgtctagtggtgactcgtggccgctagttagtgttcgctgaagattggtgtcgtattcactggtgtcgccttaggcaaactcctggctaatcgacctacgttgcgtctgcgtttcatcaccaaataaaagaatcgccacggggagtggaattccagtatgctgctactggatctaagtcgcccatggtgggtgctgtaggtcgttaattcgtggatcgtattaatatggaatcacgatggtgaatttcgttatcggacattaggacactgttctggaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttacta

SEQ ID NO: 453519 - DNA, 4378 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccaatagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctctagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataa

SEQ ID NO: 453520 - DNA, 2558 bp, Homo sapiens
atcatggagcgctctccgatctcgtcccggtcttccttctcctggaagttggctgtcgcgcatcgcggacgatcccctcccgtctgtgtcgtggcccgcattgtcctcagctcgatatttctattcattctcctatagttttttccgtgtttacaaacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctctagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataa

SEQ ID NO: 453521 - DNA, 3646 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccaatagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctctagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttacta

SEQ ID NO: 453522 - DNA, 3013 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccaatagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctctacttggggagctgagacaagaatcgcttgaacccgggagttggaggttgcagtgagctgcactccagcctggcgacagagagagattccatcttaaa

SEQ ID NO: 453523 - DNA, 1320 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggtgagaagctctcccggtcctgccacatttggaaagactgtatctgttccaggtcataccatgtgacctaatatgctggaccctgccgcctcagggaccttcagagctctccttttgctgagtcatccttttcttgactggtcactttcagacccccactgtgaaagcctgaaccaaaaataatttctcctggcctagaggtggtgaatgagagaagaggtttttgtttttccttgaagccacaaaaaggagttaataaggattgttagagccatcagtctggcattaaagagcagattggtgtggaattgggcaccaacaagaatgagtaatatcttaattaggtttaaaaacgatggtaccttgcgcatacatatgtaagattccttagagggaagagaggccattccctgtttgtgtaagagtatattccttaattaacaaattaagcagcaatagataaaaaaataaataaataaaaacaaaacaaacaaacaaaaaagaatgtattcctaaaattacctctttatttcaggaagaaagaaaagaaggaccgttgtctcaattttcacagtgaagggaactgggcaacaaacctcacatggatgacctatttttcttcctctggcaactccacctttaggtcatgaagagaggagaattgctaaagggaacaggagcctctaagctggctgcctccctcttctgcactgtgctctggcctggcttttgttgttgaaggggctgctttcctgctggcattcttgctccctggacagattcttgcaatacccaggtagcagtagcctgccagcgtggttttgataaaagcacatgcccacggtccattcc

SEQ ID NO: 453524 - DNA, 261 bp, Homo sapiens
attatctacccaccacctcaggtaccagtagagaggaacacaagacgacgggcatcactcctcagccgtcctggggataactcactggcctgttttctggtcagcttttttaggagtttgagccctcgccaccctgagccctgatctaagtgtttggtaaccaggcttattgaattgtctccctccagggattttatggatccaacaatggacaacaccaagcatatattaaactatctgatgcccatcattgaccaggtg

SEQ ID NO: 453525 - DNA, 428 bp, Homo sapiens
gtttcccccatccgaacttgctcgggaggccgctgcccaacagcaagctgagaggtgagcaaggctgggacactggttgaatgggggtggctgtaaatgagcagaagcgagggaaggtttgtgtctggtgggatagggttggggcatgtttccagagatctgagcttaggccagtggaatccccactgtagacatatgggtctttatcataaagagctttcccagcaatgaaaggctctgcccgcagcctatgtggtgtagttttgctttcctcctcctctttcataccacttccttccttccgtctctttcccctgcaggacggcagcctctactttcaaagactttgagctggcatcagcccagcagaggcctgatatggtgctgcggcagcggtttcggggacttctgcggcctgaagatcgaac

SEQ ID NO: 453526 - DNA, 4450 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccaatagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgagatggagtctcactctgttgcccaggctggagtgcagtggtgcagtctcagctcactgcaacctccgcctcccaagttcaggcaattctcgctgcctctagcctcccgagtagctgggactacaggcacctgctaccacgcctgactaatttttgtatttttagtagagatggggtttcgccacgttggccaggctggtctcgaactcctgacctcaggtgatctgcccgtctcgtcctcccaaagtgctgggattacaggtgtgagccaccacgcccagccaccactacgcactttaaaaccaaaaaaagctcaaagggatggatcattgtccatggctcaggagccccactgtggggtaagtgtgatgtcgatggattaatttagacagtggtgtattcatcagggcaaaggaaattcttccagaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataa

SEQ ID NO: 453527 - DNA, 2980 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccaatagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataa

SEQ ID NO: 453528 - DNA, 1492 bp, Homo sapiens
tacctagttcgtctagtggtgactcgtggccgctagttagtgttcgctgaagattggtgtcgtattcactggtgtcgccttaggcaaactcctggctaatcgacctacgttgcgtctgcgtttcatcaccaaataaaagaatcgccacggggagtggaattccagtatgctgctactggatctaagtcgcccatggtgggtgctgtaggtcgttaattcgtggatcgtattaatatggaatcacgatggtgaatttcgttatcggacattaggacactgttctggaggtgatgatgcggcagatattcccagtgctctcccaaagcaagctggccctcttgtcatcctctcagtgggcggcaccagctgcccctccttccacaagtactcaagcctgtttgtaaatactgaaggaattgatggggttgaggaaaggaggtgcatgtgaccagggtcccaaggccacagcttttcagatcctaggaagcaagtggcatttgcttgagttgtggcctcggaaggagaatgtttatctgttttctaactttgctgacaccaggattctccctgtcattgagaagaaagcattatctaattaccttcaggtggtttacttattctgtaaagaatatgtgtaaatattttgtacagagccctgtatcaaataaacagccatatgtggttactaatcacctcttctgtcattccgtccttggccaccgctcagtgggaatggtctctgatctggatgctcccaccttccatgtcaggcccagaactgtgccatggtctgtggactcctggtcagccttgactggctaggagaccttgggcagtacctacagtcttgctgtttctgtttcatctgcaagaattatgacccacacactccagctgcagcccagggcactgtgatattttatacgtgtgtagatgtttttgtccacagttcctggttcatcactcccataaccctttgttataatgttgggacactgcaggcctcagaaaacggaatctctgtctgtgaccttctcctgccccatttcacttgctcaacaccagactttaatctgactgtagctcataagaccctcattccagagagggtgctgccccatacccggaaggaggaacgctgcacagagaggccaagaagcatctggacagacaggccttgctgggtttagaccttatgctttttgtccagtttcatctcaacacagctgccatgcttcagccatgcctatccaatgacgtctccataaaaggcccaggaacacgggagcttctgaagagctgaacatgtggagggaggggaacgagaacttgtccatgtgccaagagggtggcgcacccccactccatggggacagaagctccagcatttgcccaggacccgtccagacctcaccctgtgtgtatcttcatctggctgtttacttatttgtatccttttctaataacgtttgtaataaactggtaaacataa

SEQ ID NO: 453529 - DNA, 2943 bp, Homo sapiens
cctgcgcgccgctggccgacggaggggagcctgccgatgccgagcgggtgctacgtcccgcggtcggagccgcgtcttctcccggctccgccaccagccggggctcgggtgggggcccggggccccggggcatggccctccggagtgcgcagggcgacggccccacctccggccactgggacggcggcgcggagaaggcagactttaacgccaaaaggaaaaagaaagtggcagagatacaccaggctctgaacagtgatcccactgatgtggctgcccttagacgcatggctatcagtgaaggagggctcctgactgatgagatcagacgaaaagtgtggcccaagctcctcaatgtcaatgccaatgacccacctcctatatcagggaagaacctacggcagatgagcaaggactaccaacaagtgttgctggacgtccggcggtcattgcggcggttccctcctggcatgccagaggaacagagagaagggctccaggaagaactgattgacatcatcctcctcatcttggagcgcaaccctcagctgcactactaccagggctaccatgacattgtggtcacatttctgctggtggtaggcgagaggctggcaacatccctggtagaaaaattatctacccaccacctcagggattttatggatccaacaatggacaacaccaagcatatattaaactatctgatgcccatcattgaccaggtgaatccagagctccatgacttcatgcagagtgctgaggtagggaccatctttgccctcagctggctcatcacctggtttgggcatgtcctgtctgacttcaggcacgtcgtgcggttatatgacttcttcctggcctgccacccactgatgccgatttactttgcagccgtgattgtgttgtatcgcgagcaggaagtcctggactgtgactgtgacatggcctcggtccaccacctgttgtcccagatccctcaggacttgccctatgagacactgatcagcagagcaggagacctttttgttcagtttcccccatccgaacttgctcgggaggccgctgcccaacagcaagctgagaggacggcagcctctactttcaaagactttgagctggcatcagcccagcagaggcctgatatggtgctgcggcagcggtttcggggacttctgcggcctgaagatcgaacaaaagatgtcctgaccaagccaaggaccaaccgctttgtgaaattggcagtgatggggctgacagtggcacttggagcggctgcactggctgtggtgaaaagtgccctggaatgggcccctaagtttcagctgcagctgtttccctgaaagccagagaagaccttcctcttacatcacattaaggtctcacccttccatggaaggattgggaggggtggaatttcctttattaaaagggtttctgtccagagttttttattcctgccaccctgccctgcccgtttgtgtttgcctttacttcagaggccaatagcagagcctacctgacacagaggggacctgggggcctggcacagaatcttatgcctctcccagtgggcttttggatgggctctctgccacctccctggtgttggaggaagtgggtttctgaagcttgcagctgcttttgcaacctgctgggcctgggctgccctagttaccgggaacctcctagtcaccccatagaaggtgaactggaacatgggatgccctcttactgctcctgcttgcctgcatcagatggacacagaaggagggggctgctgctgaaggagtcaggcttgggatggagagcaagaggccaaaggactcgtctgggagcatgatcggcccctcttactagcagctccatcagctgatcagaaatcagagacagaagggaactaggttactcgttaaatcctacctattttcagcctagaaatcacatgggcgtttccagtcaagtgggaaggaagctcatttttagggcctagacctagactagttttgcctgcctttttttcctccctgctttcttctacaagccacacaacattgcttataaaaggtacttttattactatttttagaatatatacaccccatatgtaaattaccctcacttttaaagtaataatagttccttcacggaaaaaaaaatagttctcatcagaaggatgagcttctaagatcctgaattttactttctacttgattaacattttcgctttagccagagttgctatttgcaaacagctttccacttccaaagtgccactttctgaccggtttttcttcctgttttcctcaaatcatcctactcccaaataggcacccactcactaccttggcgtcgttttttgggtctgacttgactcgtcaactgctggtctctcccacctggttggaaatgtcgttggaaacttgcaaagactctccagaccttagggaacaagaggcatcactcagtccttctgggacagcttccctgtaagcaaagccaggtttgttttagattcactctggcctgaaaaaaaaagtgccttttgctgctttaaagaattggggtatatggtatgaagcagccatgtacttgtattttcctggtctttcctgggcactcttctctcttggcagatgttttcttaaagtgaacacaccagaagcactctaccccaccatatccagtcctctttgcatgcctgttgtgtgcagggtggagggtgtcccacgtgccagagcagctgggagccctgtccgctgagttacactaagcactttatttttatttattttattattattttcttttttctgggcattagagcagactccatctcataataataatacataataagctattattttctacctgatgtcatcaggtgttaatccacctctatatctgttggccagtgaaatactttgggctgggacgttg

SEQ ID NO: 453530 - DNA, 1598 bp, Homo sapiens
aatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgtt

SEQ ID NO: 453531 - DNA, 1800 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453532 - DNA, 421 bp, Homo sapiens
cccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgtt

SEQ ID NO: 453533 - DNA, 265 bp, Homo sapiens
ccaaccctttatacccttaacccagtcctctacccaaaccctcccatttgccaaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaa

SEQ ID NO: 453534 - DNA, 2652 bp, Homo sapiens
aatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453535 - DNA, 1710 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453536 - DNA, 2792 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgctttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453537 - DNA, 3644 bp, Homo sapiens
aatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgctttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453538 - DNA, 1755 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaatatctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453539 - DNA, 932 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttaaaaaaaaaaaaaaaaaaaaaaaaaaaaaaaaaaaaaaaaaaaaaaaaaaacaaccacacaaagaaaaggaacaaaaaaaaaacaagaaggcgacgagccccgggcacgggccagaggcggagcgcgaggaggagaacgagcgggcggccacgacagaaaacggggagcgagcgcaccggagacag

SEQ ID NO: 453540 - DNA, 1762 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcgcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaacttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaa

SEQ ID NO: 453541 - DNA, 746 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgtt

SEQ ID NO: 453542 - DNA, 2195 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcgcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453543 - DNA, 1552 bp, Homo sapiens
gctgatccgcttaagcgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453544 - DNA, 1746 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatgtctatgcagatggtagtatatgtctggacatacttcagaaccgttggagtccaacctatgatgtgtcttccattctaacatccatacagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaat

SEQ ID NO: 453545 - DNA, 1765 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgctttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactctt

SEQ ID NO: 453546 - DNA, 1367 bp, Homo sapiens
tacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggttgcaggaggatcctccagccggagtcagcggggctccgtccgagaacaacataatggtgtggaacgcggtcattttcgggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaacttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaa

SEQ ID NO: 453547 - DNA, 2609 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453548 - DNA, 846 bp, Homo sapiens
caagcatacaccaccatgcctggctaattttgtatttttagtagagaggggcttggccaggctggtctcgaactcctgacctcaagtgatccatccacctatgcctcccatagcattgggattatgggtgtgagctaccatgcgcgactaggaaagtctttctgaatggctcatgccaccttcctctccctggctataccaatggaccctttagtgactttgtagcctatcctcctctcaaaataattagctccttgaggaagaataatagattttctttttaaaaccccactatatctaacacaacagattcttcctaaataccattggttaaataggccatgcacatcatagccttgtcattacagatggtaccagattaaactgattgttggatttgctttggtacctgtataaccatacaaacccagatattaaaacaccagctctgttccattgtttccttatggtggcctggtgaagttaatctgtatcagataaactctccttatatgtgaatatgtaaagtcagctttttaggtcagctaaattttgctttgcctactaaattaacatggtaaaattagaaacagtctgacaaagtagttaatgtataattctaaaaggccttgagattttagtacttgaccattttgaacatttggtaggtacatctgctcagtctattgacttgtgaatagtcaatagaacaaaacttcagagttctctgttgactttttggagaagattttatattagcagatgaaatatagttggtgaaaataaaattggaagagagtctgtaggcctactttctctatgagaatcgtcatgttagtccatcta

SEQ ID NO: 453549 - DNA, 2678 bp, Homo sapiens
atgataaatttaatcccgtttcagaccttgaaggaagtaattttgaagttattggcaacatacatcaatattctaatttattagttgatgacaccgaccgtatcagtcctgatgacatcggcaatgatattcatgagtttttacacggaggagataagtgatggctgttgaatatgaaaatggtggtcatggttacgtggaacatgcatctataggaggcgttattgtacacgtgttttatgcagacgataaggaagaggaggataaataatgttagataactttgttgaattgaaaaataagtatgccgatgaacttggaaaccgtggtagaaagtgtgatgagatgaaattcaccagcgaaaaagttaatgaattgatcggtgttgatgaagcgtttaaagttccaaacaagttaatgtcaatcatgatgaatcgtgaacaacgtgagcaaacgtttaaagcatttttggaagttgagcgtgatacatcattcgattggttccatgaatattttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453550 - DNA, 2555 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaactggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453551 - DNA, 2554 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaaatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453552 - DNA, 2555 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453553 - DNA, 1622 bp, Homo sapiens
caaatgcaggccactatgcccagcaagttatttttttttatttgtagagatgatgtcttgctgtgttccccagtgaggcaccatctctgggcaatagtctcaaactcctaggctcaaggaatcctcctgcctcagcctcccaaagtgctaggattataccatgcccagccaagatatgacttttaaaagaaaacagggtgaaattcaaatgtataatgagtacagattgattcataccatttatagataaattgttttaagattaaaataaatgttcacatggaaagtgaactactgaaagaactgagctgtcactttaatattcttcacttgtaaatccttgctttaaacaaaaatgatagcggacatggtttaacagttgttgctgtttttagatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453554 - DNA, 1396 bp, Homo sapiens
aaaagttatcgaaaccattcgttgtggtgcgcgggccctggataggtaatttgaacatggatcgtatgcctgtctcctagagagagtccttggtcatgattagtgctctggatacctcatcattaaagaaagcagcccagggctggtcataggcctgtagccgttcttgaatgacatcccacgatagaatggtctgagtgtctattattgggatctatcgtactaggagtgccagccgcgagctcggatcatctaaaattacagcatcgctgttcgatgagcttgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453555 - DNA, 1904 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgaaaacgttaaatgagaagaactaaagaaatgacatgctaggtttgataaatggtttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgcccatgtgcagaaaaccacccctttgcaggtgagcagatagcttgttcagcccttcttcaaataagaaatcattgtgggtcctttatgacttttatgtgtgataagcatagttaacaaagtagcgaaatgcaagaaagt

SEQ ID NO: 453556 - DNA, 1226 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaactacctaggatagcgcctatatataggcgcctatcaagggatcctctagaacaactatcgccaaca

SEQ ID NO: 453557 - DNA, 632 bp, Homo sapiens
gtttttctctaaatgagagataatctgattctattttggatctgtgtacattctaagtctttctctcatttagagaaaacattctcaagtctatagaagaggaaaaaaaattaagattagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453558 - DNA, 917 bp, Homo sapiens
caaatgcaggccactatgcccagcaagttatttttttttatttgtagagatgatgtcttgctgtgttccccagtgaggcaccatctctgggcaatagtctcaaactcctaggctcaaggaatcctcctgcctcagcctcccaaagtgctaggattataccatgcccagccaagatatgacttttaaaagaaaacagggtgaaattcaaatgtataatgagtacagattgattcataccatttatagataaattgttttaagattaaaataaatgttcacatggaaagtgaactactgaaagaactgagctgtcactttaatattcttcacttgtaaatccttgctttaaacaaaaatgatagcggacatggtttaacagttgttgctgtttttagatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgaaaacgttaaatgagaagaactaaagaaatgacatgctaggtttgataaatggtttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgcccatgtgcagaaaaccacccctttgcaggtgagcagatagcttgttcagcccttcttcaaataagaaatcattgtgggtcctttatgacttttatgtgtgataagcatagttaacaaagtagcgaaatgcaagaaagt

SEQ ID NO: 453559 - DNA, 863 bp, Homo sapiens
caaatgcaggccactatgcccagcaagttatttttttttatttgtagagatgatgtcttgctgtgttccccagtgaggcaccatctctgggcaatagtctcaaactcctaggctcaaggaatcctcctgcctcagcctcccaaagtgctaggattataccatgcccagccaagatatgacttttaaaagaaaacagggtgaaattcaaatgtataatgagtacagattgattcataccatttatagataaattgttttaagattaaaataaatgttcacatggaaagtgaactactgaaagaactgagctgtcactttaatattcttcacttgtaaatccttgctttaaacaaaaatgatagcggacatggtttaacagttgttgctgtttttagatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgcccatgtgcagaaaaccacccctttgcaggtgagcagatagcttgttcagcccttcttcaaataagaaatcattgtgggtcctttatgacttttatgtgtgataagcatagttaacaaagtagcgaaatgcaagaaagt

SEQ ID NO: 453560 - DNA, 792 bp, Homo sapiens
caagcatacaccaccatgcctggctaattttgtatttttagtagagaggggcttggccaggctggtctcgaactcctgacctcaagtgatccatccacctatgcctcccatagcattgggattatgggtgtgagctaccatgcgcgactaggaaagtctttctgaatggctcatgccaccttcctctccctggctataccaatggaccctttagtgactttgtagcctatcctcctctcaaaataattagctccttgaggaagaataatagattttctttttaaaaccccactatatctaacacaacagattcttcctaaataccattggttaaataggccatgcacatcatagccttgtcattacagatggtaccagattaaactgattgttggatttgctttggtacctgtataaccatacaaacccagatattgtatcagataaactctccttatatgtgaatatgtaaagtcagctttttaggtcagctaaattttgctttgcctactaaattaacatggtaaaattagaaacagtctgacaaagtagttaatgtataattctaaaaggccttgagattttagtacttgaccattttgaacatttggtaggtacatctgctcagtctattgacttgtgaatagtcaatagaacaaaacttcagagttctctgttgactttttggagaagattttatattagcagatgaaatatagttggtgaaaataaaattggaagagagtctgtaggcctactttctctatgagaatcgtcatgttagtccatcta

SEQ ID NO: 453561 - DNA, 747 bp, Homo sapiens
tggtgaaaataaaattggaagagaaaatactattctgggttgggtatccttaaggattagaaccacaggactcctccaagtctgtaggcctactttctctatgagaatcgtcatgttagtccatctaactgacctcatctctctttcaatgcaggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaaga

SEQ ID NO: 453562 - DNA, 996 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattattgcgtgatgaggcttattacccagatttttcccattccactttgttcaagacagact

SEQ ID NO: 453563 - DNA, 2539 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453564 - DNA, 2167 bp, Homo sapiens
attcaacagatactgagtgtctgcccagagggcttatgtgctcaatgctagggatcagcactgaacatggagtggttggagtctcaattccaataccttatacaaagagctgtttactgcctatgaacctatcatgagctgtatttttctcctgtaagtattgtgtttatttgcttctacttccaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaattttctttccaaaaggcagcttgaaatgttggtcctaatcttaattttttttcctcttctatagacttgagaatgtttttctctaaatgagagaaagacttagaatgtacacagatccaaaatagaatcagattatctctttttttctaaaggagagaaagacttagaacatacacagatcctaagtagaaccaggtaattgtctctttttctaataaggaatttgggtaatttttaattttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453565 - DNA, 2372 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatcactaccattaaagttaacattcgtaatgccaattccctgggaggaggcttccattgctggacctgcgatgtccggcgccgaggcaccttacagtcctacttggactgaacaggcctgatggagcttgtggctggcctcagatacacctaagaagcttaggggcaaggttcattctcctgctttaaaaagtgcatgaactgtagtgctttaaacaatcatctccttaacaggggtcgtaagcctggtttgcttctattacttttctttgacataaagaaaataacttctgctaggtattactctctactcctaaagttatttactatttggcttcaagtataaaattttggtgaatgtgtaccaagaaaaaattagtcacctgagtaacttggccactaataattaaccatctacctctgtttttaatttttttgttttttaaaaaataacctagactatgcaaaacatcaaagtgaattttccatgaatgtttttaatattctcatctcaacattgtgatatatgctactaaaaaccttttcatatacatcttacctcatttcaagtgaattattttaatctttttctctctttccaaaaatttacaggaatgtttagtgtaattggatttcgctatcagttcccatccttaagttttgatattcaatatctgatagatacactgcatctttggtcatctaagatttgtttacaaatgtgcaaattatttagagcatagactttataagcattaaaaaaaactaatggaggtaaaacctaaatgcgatgtgaaataattttagtgttgatactgtatgtgtatttttattctaataaacttttgtgttccagattgaaaaaaaaaaaa

SEQ ID NO: 453566 - DNA, 1850 bp, Homo sapiens
aacgggccttcttgcgacgctcgggtctgggtccgggtccggacgtgcaacagaagccgtcagtggccccgctggctaaaaaagggcaagcatcggaggctcgagccagcggccgcggcgcttcccgacagttcctaattcggggcgctacgccggccccaccacctgttcccggcagccaatggggccgcggggggcggccggggcggagcgcggctacaaaaggcctcgggccccgcgcgcccgcccaccccgctccgggcgcgctctcgggaaggcttggaccgacgcggcccagaggccaggaacattccgcgcgtggaccagccgggccagggcgatgctgcgggtgcggtgtctgcgcggcgggagccgcggcgccgaggcggtgcactacatcggatctcggcttggacgaaccttgacaggatgggtgcagcgaactttccagagcacccaggcagctacggcttcctcccggaactcctgtgcagctgacgacaaagccactgagcctctgcccaaggactgccctgtctcttcttacaacgaatgggaccccttagaggaagtgatagtgggcagagcagaaaacgcctgtgttccaccgttcaccatcgaggtgaaggccaacacatatgaaaagtactggccattttaccagaagcaaggagggcattattttcccaaagatcatttgaaaaaggctgttgctgaaattgaagaaatgtgcaatattttaaaaacggaaggagtgacagtaaggaggcctgaccccattgactggtcattgaagtataaaactcctgattttgagtctacgggtttatacagtgcaatgcctcgagacatcctgatagttgtgggcaatgagattatcgaggctcccatggcatggcgttcacgcttctttgagtaccgagcgtacaggtcaattatcaaagactacttccaccgtggcgccaagtggacaacagctcctaagcccacaatggctgatgagctttataaccaggattatcccatccactctgtagaagacagacacaaattggctgctcagggaaaatttgtgacaactgagtttgagccatgctttgatgctgctgacttcattcgagctggaagagatatttttgcacagagaagccaggttacaaactacctaggcattgaatggatgcgtaggcatcttgctccagactacagagtgcatatcatctcctttaaagatcccaatcccatgcatattgatgctaccttcaacatcattggacctggtattgtgctttccaaccctgaccgaccatgtcaccagattgatcttttcaagaaagcaggatggactatcattactcctccaacaccaatcatcccagacgatcatccactctggatgtcatccaaatggctttccatgaatgtcttaatgctagatgaaaaacgtgttatggtggatgccaatgaagttccaattcaaaagatgtttgaaaagctgggtatgtacaacaaatgaaacatgttgtcatacatgttgtctaattcaattttgattccttttagaggcaccaagttattatttcacagaaagtcagtatttttattttcaacacacgtagccccaacaagttggagatgcatcctgagctcctgagacatccccttaacaataagtttataaatcttatatgacttagccaacgttttggtgcccatgtgcagaaaaccacccctttgcaggtgagcagatagcttgttcagcccttcttcaaataagaaatcattgtgggtcctttatgacttttatgtgtgataagcatagttaacaaagtagcgaaatgcaagaaagt

SEQ ID NO: 453567 - DNA, 4868 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453568 - DNA, 3801 bp, Homo sapiens
gtcttgctggtgtccccgcgttggagggtcctggggagggagaggcgggcggacccagcagcgcccatggacttggtctcctctctggagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453569 - DNA, 3736 bp, Homo sapiens
ctgcggtgcgtgccccccaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcacgctatctggctgccctggactctggcagccacgcgggctggcagtttaagcccatggacagtgcccgaacgctgtggtagctgttccctcagagcgacagtacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453570 - DNA, 3121 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453571 - DNA, 4560 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctc

SEQ ID NO: 453572 - DNA, 1641 bp, Homo sapiens
agcaagctatgtcatcaggtcgaggccgggtttaaatcagccgagggcatggcactgtgcttgggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453573 - DNA, 5075 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccccgcccaatcggactgccaaattctccggttgccccgggatattatagaaaattattgtatgaataatgaacacattaaaaacacaaccctgggtgccacaaatagaagaaaaaaaaacaaaagagggcacaaaaaaaaaaaacaacaataaaaaaaaaaaaacagtgtgtggcgggcgcgcgccgcagcaccgcacacaggtatctttttgctgaaacaacgatcagtggatgatgagggctgcagatgatccgcacgcgcgagttgctaaaaaaacaacaggcaggaccaactccaatccaggtggaagcccacgaccaacatattggtggggtcgacgaagacacagctgtcatcagattttgtctcaccaacccaatatagtcaagcgcagagcgcggctc

SEQ ID NO: 453574 - DNA, 2113 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcacgctatctggctgccctggactctggcagccacgcgggctggcagtttaagcccatggacagtgcccgaacgctgtggtagctgttccctcagagcgacagtacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggacctcggagcggcagctgccaaagcgtgagcgtgctcctgcctcccgaggcagggaaagaggttgggcggtcggatcggtactgaatggacgatgcagctccgccaaacgggagcctaaaggg

SEQ ID NO: 453575 - DNA, 525 bp, Homo sapiens
tggacccggccctgagcccggaggaggccttggcccggccctggagggtggctggtttgtgtccttcaggtcctgggtgcgtaaggtgcaggtagggccttggagctgtggctcctgggggtggcagaactctgcctggcccaatgcccaaatgccgctggtgtgggcatgggaggctgtgtgtacgcccctcctcagaggagacatcccctgtcctgagcctggagagttcgggggctgcccctccctcagcctcagccagacctagagcgcaggggcccccagccagcggcccctccttagcccctccctataggctctgtcagggcaccctgtactgtcccattctgcccccagggctgttggctcagccaagtgaggaccacgcggaaggcgcccctggctgcgtgcgccatgcaggggccctgctgatgcctcccccttgtctccctccagtacacctccagcatgagagccaaatacctcgccacgagccagcctcgccctgactccagcggcagccac

SEQ ID NO: 453576 - DNA, 769 bp, Homo sapiens
gctccaggcccagggacagcatatgcctgggtgtagaggccacagagccctgccccgagccacaccccagccctgcccgctcctcaccagccagtgccccaggcatccctgccaggccagggaggtcttgctctggcccagggtatactgggatcctatcggtagcaacctgatctgggacagagtaaggcttcaggccccggctctctggctggctgggtgtttccagagttggtggggttttgggggctgcattttgggggctgcggggcagtcgggggagtctgggctcacggtgggagggggcatcccccatggatgccgtctgtggctgtggggctgcaggggcttggagaaggagggggtggcccagggccgagaccaggagccctagggtgggggcagggggactgaggctgcaggagggggtcgcccccagcccccttggcacatgtgtggcagttgagtcctctccgtgtgctccgcggaacccagcgtgcagttttcgcctcgcctgaccgagcccttacatcacttccaccacagacggaaaattccatttggtcagagcccagctgctgatcagacagttcccattctttctctgaatgggccagggaggggcggaggggccgccagcccggtggagagaggtggctgggccaccgtaggaatgccgctggcccggtgccccgcaggagaccgtctgctgggaatctggcttcgggaagtgggtgcagaggccaggctggccacggcacgctccccg

SEQ ID NO: 453577 - DNA, 3800 bp, Homo sapiens
acgctctctctgtgggggttctggaaattagcgttctggctcatgtactcagtgaccggggcgttgctgacggtgtgggccgcggccgggatgctggtctcactgccgtagctgctgccacagctgtacaggctgggcatgtggacgcggtagaggctgtcgtgcgcctgccgcggccctggagcgaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453578 - DNA, 3294 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453579 - DNA, 4981 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaaaagaaatgaagaaaaagagagagagacagagaaatagaaagaaaaaaggggagggacatagaacaaccccggggggcccacatagagagagaacagatttaggcaaagggaaa

SEQ ID NO: 453580 - DNA, 5024 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctgaggctgcaggagggggtcgcccccagcccccttggcacatgtgtggcagtcgggggagtctgggctcacggtgggagggggcatccccatggatgccgtctgtggctgtggggctgcaggggcttggagaaggagggggtggcccagggcgaggacccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453581 - DNA, 4739 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 453582 - DNA, 1155 bp, Homo sapiens
cgggggagaacaaattggcttggtctgagtcctgtttgctttctggcactgtgtgggctgtcgatgcggagcgagcgcagcgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggcatcctgcagtactaccatgcctacaaccccatgccgcacagatcctcaga

SEQ ID NO: 453583 - DNA, 989 bp, Homo sapiens
  misc_feature (902)..(902): n is a, c, g, or t
actagttctagatcgctcgcgatctagaactagtcgacccacgcgtcgggcaggagaagatggcgaccgtgtgggatgaggccgcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgcaagcttgnagtgaaaggtggccgagtgtaggaattggctttacactgaggccccaccacattggttgcaagggtggggcccctcggggaagaaag

SEQ ID NO: 453584 - DNA, 1577 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453585 - DNA, 1430 bp, Homo sapiens
gtaactcggcgaggggcattattaatccacatggtttgttctaatgcaatttattaacccagcatggtttgtagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453586 - DNA, 1490 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgagtcgagcggccgctaatttagtagtagtagtagtagtagc

SEQ ID NO: 453587 - DNA, 1227 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagcctcatcagtggtggacagctcgccaggcgtcagccgac

SEQ ID NO: 453588 - DNA, 1447 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453589 - DNA, 1177 bp, Homo sapiens
  misc_feature (1090)..(1090): n is a, c, g, or t
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgcaagcttgnagtgaaaggtggccgagtgtaggaattggctttacactgaggccccaccacattggttgcaagggtggggcccctcggggaagaaag

SEQ ID NO: 453590 - DNA, 1342 bp, Homo sapiens
gcctgtagtcctagctatttcgggcaggatgaggccgcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453591 - DNA, 1389 bp, Homo sapiens
actagttctagatcgctcgcgatctagaactagtcgacccacgcgtcgggcaggagaagatggcgaccgtgtgggatgaggccgcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453592 - DNA, 1343 bp, Homo sapiens
cccacgcgtacgcccacgcggtcggtgggatgaggccgcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453593 - DNA, 1280 bp, Homo sapiens
cccacgcgtacgcccacgcggtcggtgggatgaggccgcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453594 - DNA, 512 bp, Homo sapiens
aggacatcaagaagccagctgaagatgagtggggtaaaaccccagacgccatgaaagctgccatggccctggagaaaaagctgaaccaggcccttttggatcttcatgccctgggttctgcccgcacggacccccatctctgtgacgaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453595 - DNA, 367 bp, Homo sapiens
agtgcaaggctgtgtgtgtggaggcggtgagtggtcagctggggtgggtgcgttgctttgtgccttcttgccccctccctggacaggatgggggcatttggctggtggagacggctgagggaagaggcctgagcctcagggagccagggaaggcattcaggcgttcagacctagactctgtttgtcccggctgtagggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453596 - DNA, 1177 bp, Homo sapiens
gcctgtagtcctagctatttcgggcaggatgaggccgcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtattgcagcacaaacagggtggacatctggacccgcctcctcgctcgggcgctttacgcagatgagtccgagccatgaggagccggcaaataggacatccgagatagtagctgagtgaaaagaggcgcggaattaggggccgcagtttgtggggcaacccgggcggacccgataagtgggtgaaatcgagcccctgggattggaaaggtgccctttagggtaaatttatttgg

SEQ ID NO: 453597 - DNA, 1625 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtcaaaaaaaaagtcgacgcggccgcgaatttagtagtagtaggcggccgc

SEQ ID NO: 453598 - DNA, 1898 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtcaaaaaaaatttttttttttttttttgcacataaaaaacgtttattgaacaaacgaatcctgtatgttcctccccccaggcaggaaacgctccctgggagggagggtagtctattggtgagctaggacgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggctcgtgcc

SEQ ID NO: 453599 - DNA, 1412 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtattgcagcacaaacagggtggacatctggacccgcctcctcgctcgggcgctttacgcagatgagtccgagccatgaggagccggcaaataggacatccgagatagtagctgagtgaaaagaggcgcggaattaggggccgcagtttgtggggcaacccgggcggacccgataagtgggtgaaatcgagcccctgggattggaaaggtgccctttagggtaaatttatttgg

SEQ ID NO: 453600 - DNA, 1272 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgtctgtttgtcccggctgtagggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453601 - DNA, 1514 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453602 - DNA, 1518 bp, Homo sapiens
gtaactcggcgaggggcattattaatccacatggtttgttctaatgcaatttattaacccagcatggtttgtagagtccagtgactcggcaggagaagatggcgaccgtgtgggatgaggccgaggtgggcaccgggcgagctggcggtccgggaaccggggcccgcagggagacgccattgacaagagggaaggaggtggctgggggtcaagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453603 - DNA, 1514 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagggtgtgaacaaagactcctatctgatcctggagacgctgcccacagagtatgactcgcgggtgaaggccatggaggtagacgagaggcccacggagcaatacagtgacattgggggtttggacaagcagatccaggagctggtggaggccattgtcttgccaatgaaccacaaggagaagtttgagaacttggggatccaacctccaaaaggggtgctgatgtatgggcccccagggacggggaagaccctcctggcccgggcctgtgccgcacagactaaggccaccttcctaaagctggctggcccccagctggtgcagatgttcattggagatggtgccaagctagtccgggatgcctttgccctggccaaggagaaagcgccctctatcatcttcattgatgagttggatgccatcggcaccaagcgctttgacagtgagaaggctggggaccgggaggtgcagaggacaatgctggagcttctgaaccagctggatggcttccagcccaacacccaagttaaggtaattgcagccacaaacagggtggacatcctggaccccgccctcctccgctcgggccgccttgaccgcaagatagagttcccgatgcccaatgaggaggcccgggccagaatcatgcagatccactcccgaaagatgaatgtcagtcctgacgtgaactacgaggagctggcccgctgcacagatgacttcaatggggcccagtgcaaggctgtgtgtgtggaggcgggcatgatcgcactgcgcaggggtgccacggagctcacccacgaggactacatggaaggcatcctggaggtgcaggccaagaagaaagccaacctacaatactacgcctagggcacacaggccagccccagtctcacggctgaagtgcgcaataaaagatggtttagggtc

SEQ ID NO: 453604 - DNA, 799 bp, Homo sapiens
cctgtggccaggggttggtctttggaatcggagaggcagattcgctgctccgcagcacggccggagctggtcgggtcaagagtcgggatttgtggggagaggttttccactggtcaagagaaggctttaagaaagacggtattaatctcccgttgcggctcccgcctggtcccatcttctgcccgctcctccaggaaatgaatctgctgccgaatattgagagtccagtgactcggcaggagaagatggcgaccgtgtgggatgaggccgagcaagatggaattggggaggaggtgctcaagatgtccacggaggagatcatccagcgcacacggctgctggacagtgagatcaagatcatgaagagtgaagtgttgagagtcacccatgagctccaagccatgaaggacaagataaaagagaacagtgagaaaatcaaagtgaacaagaccctgccgtaccttgtctccaacgtcatcgagctcctggatgttgatcctaatgaccaagaggaggatggtgccaatattgacctggactcccagaggaagggcaagtgtgctgtgatcaaaacctctacacgacagacgtacttccttcctgtgattgggttggtggatgctgaaaagctaaagccaggagacctggtgggtgtgaacaaagactcctatctgatcctggagacgctgcccacagagtatgactcgcgggtgaagcctgagtaacaaggccaggacatacaggactggggtggcaaccaccgaccgcgcgcctgccgcagacccggactcatgggccc

SEQ ID NO: 453605 - DNA, 3595 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaacaaacaaaaaaaaaaaaaaaaaaaaaaaaaacaccccgggggcactcttttggcgggggggcgcggcacaacagggggcaacgggaaggggccaaggggcaaaagggtgtcccgggccccagtttcctgtggtaccaagggggaaaactcgggggggacccccaatatagggggggcgtaataaatcgaaaaacccgggtacccgcggctatagggcacgcggcggacaaacacgcaccgagagcacagcaccacgacgacgacccacgcaaccagacacacacgccacgcagacacacgcggcgcgacacaccagcaacggggcgacacagcagcagacccggcaacacagactcacgcggggggtggtagcagagcggatgtgcatgcatgtgacgagtagtggggagtgcgaggccgcggccgcgcgccgctggacgaccagactgagagctatcggaatgaggggtacgaacggacaggggagaggagggcacagggtacggggacggagagggagggcaggggccgcccgggcgacggcaggaaggggcgagacagagggcaaggcgtgcgcagggagagaaggacggagggaggcggaggaggcgccgggagggagaaggagagggaagagggcgcagacggaggcggccggagcgaggcgaggaaggggaagggggagcg

SEQ ID NO: 453606 - DNA, 3210 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaacaaacaaaaaaaaaaaaaaaaaaaaaaaaaaagggggggggggtaaaaaattcccgggggggccaaaattaggcggttacccggtttttgtgagcaaggggggccctaaagggagcggatataaaaagcaggagcaggggggtgtaaacaaggtgggcgggcgaaatggctgtggcatttctgggaagggactcattgtggggtgcgccttctggcgcatactcaggaataagtcggggcaattaaactttagggtttgggtcacactgttgtctgtggtgaaattggcagggtggtgaata

SEQ ID NO: 453607 - DNA, 3379 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaacaaacaaaaaaaaaaaaaaaaaaaaaaaaaaaaaaaaaaaaaaaaaaaaaaaaccaaaaaacaaaaacaaaacaaacaaaaagaaaaaaaaaaaagaaagggggggacgacgcaaaagaaacaacaccccaggggggggcacaccagcaggcgccagccaccactctacactttggagccaacggcagcgccccccaaacctggccgggcagcgatagacaaaacgcagcgcccaagcaccgtgaaaaaacaaaacaccggagtgaagacgaagaccagcaccgccgcgcgggccaacccagagcagaacaccacacacctcggccgcgggaacccgcagcgcgcacacccacacaacagagcagaagcacgcacgcgcgcacacaacaaccacgcacgagtgagactggcgcccaacacaaccaccgagccggacatccaagcacaccacacacaatacgcgaaacaacc

SEQ ID NO: 453608 - DNA, 2744 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatagtgtcccccgggtcaaagtcctaggaaagaaaaccctgattgcattattggcccatgccaaaatgctgggactgactgtaagtttaattcaagatcgctggacgtactcagattgcaccaggctctcaaactgtcctagggtttgggccaggaccagcaaccta

SEQ ID NO: 453609 - DNA, 1554 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaatgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggca

SEQ ID NO: 453610 - DNA, 929 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggca

SEQ ID NO: 453611 - DNA, 2902 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggca

SEQ ID NO: 453612 - DNA, 3440 bp, Homo sapiens
  misc_feature (3122)..(3122): n is a, c, g, or t
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggcaaaaaaacaaacaaaaaaaaaaaaaaaaaaaaaaaaatgggggtttttttggggggggggaaaaagggtgaaaggggcgtggtcataggcgtggttcctgggacccaggtttttttgtcacaaggggggaaaatcgggcggggtcccccaaaaaggagaggccgggaaaaataccgaaaaacgccgggtaaccccgggattattgcactctcgcaacagancacacacgacgcccgccgcacagcgaggtgagagcgaaacgggcaacaaggagggagccacccccttggacgcacgacaaaaaaaccagggaccaagaaaccaatgctgtatacgaaccagacaaagaaaacaccggtaccacggcagaaggaaaagatcaagaaaatatagaacgacgcacactcgtcaattcacgaacaacgtcgcgtatccagcacacgtcggcgaccacgaacacgcacacacgagctcagacaatggagagccaccatcaaacaatcaaacacacgcataaatccagcggaacacagagacag

SEQ ID NO: 453613 - DNA, 3411 bp, Homo sapiens
  misc_feature (2808)..(2808): n is a, c, g, or t
  misc_feature (2811)..(2811): n is a, c, g, or t
  misc_feature (2813)..(2813): n is a, c, g, or t
  misc_feature (2825)..(2826): n is a, c, g, or t
  misc_feature (2833)..(2833): n is a, c, g, or t
  misc_feature (2840)..(2840): n is a, c, g, or t
  misc_feature (2842)..(2842): n is a, c, g, or t
  misc_feature (3093)..(3093): n is a, c, g, or t
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcaatttgggtggttnccncngaatggccgctnntgggccntggaagncnggccttgtggaaaaaattggggcaacacacaaaaaaacaaacaaaaaaaaaaaaaaaaaaaaaaaaatgggggtttttttggggggggggaaaaagggtgaaaggggcgtggtcataggcgtggttcctgggacccaggtttttttgtcacaaggggggaaaatcgggcggggtcccccaaaaaggagaggccgggaaaaataccgaaaaacgccgggtaaccccgggattattgcactctcgcaacagancacacacgacgcccgccgcacagcgaggtgagagcgaaacgggcaacaaggagggagccacccccttggacgcacgacaaaaaaaccagggaccaagaaaccaatgctgtatacgaaccagacaaagaaaacaccggtaccacggcagaaggaaaagatcaagaaaatatagaacgacgcacactcgtcaattcacgaacaacgtcgcgtatccagcacacgtcggcgaccacgaacacgcacacacgagctcagacaatggagagccaccatcaaacaatcaaacacacgcataaatccagcggaacacagagacag

SEQ ID NO: 453614 - DNA, 1873 bp, Homo sapiens
agcgggctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaatcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggca

SEQ ID NO: 453615 - DNA, 136 bp, Homo sapiens
gcggagccggcttcttcatccggaggcgcatgtaccccccgccgctgatcgaggagccagccttcaatgtgtcctacaccaggcagcccccaaatcccggcccaggtcagccagccctgtccttgtctctcctccc

SEQ ID NO: 453616 - DNA, 493 bp, Homo sapiens
gggagccgctctgcctccaacatggcgatcgttgatgtgaagatggtctccctgtgtaacttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453617 - DNA, 556 bp, Homo sapiens
  misc_feature (4)..(4): n is a, c, g, or t
  misc_feature (23)..(23): n is a, c, g, or t
aaangcacccgggcaggtgcaanttgaaccttttccgccttccaaagtggccccaggaaaagggcccacaagcgcctcactgcatctgtgcaaacgggcggcaaactgtgtcctgggcagtaaccccaaagtcattaggaaatgtgaatttcactgtgagcgcagaggcactagagtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453618 - DNA, 352 bp, Homo sapiens
gaagctggtgtgggctttgggttcatcacaagtttgaggcagagtctgcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453619 - DNA, 633 bp, Homo sapiens
caaagtctgatcttatttatttgttactcacgagggtattgatgaatgtaaaaattttcttctcccatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcccaga

SEQ ID NO: 453620 - DNA, 547 bp, Homo sapiens
ccctctgttctccttccctctctactccctttcttatgtgtggtttcaggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctct

SEQ ID NO: 453621 - DNA, 387 bp, Homo sapiens
atttgggaagacttacgtgtaccttttagagctgtggaatgcttaacatggacatagaagaagaaaatatttaaaaacacagaaaaccctaatcctttcctctccctggagtcctcagttacacagggagccgctctgcctccaacatggcgatcgttgatgtgaagatggtctctggcttcattcccctgaagccaacagtgaaaatgggtaggtttatcataaccccagactgccctattttatttaatgatgtatgtatccccagcataagacaatactaatatcaaaatactattaaagtcaatctctatcaaagccttatcctttttccagctcagaaatataatcacatgtgtttgtatgaatgctgaccatgtgcagagc

SEQ ID NO: 453622 - DNA, 508 bp, Homo sapiens
gaacagagctatgtattggcattgacagaggtatatgcgttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccagtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453623 - DNA, 310 bp, Homo sapiens
cagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgca

SEQ ID NO: 453624 - DNA, 4586 bp, Homo sapiens
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453625 - DNA, 4592 bp, Homo sapiens
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgcagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453626 - DNA, 3280 bp, Homo sapiens
gtagaacatgagtaggcagacctcggagctgcattatgtagtgttactcatggaacgataaggagctttgctacagagtagcactggccacgtgcatctatgagctaggcactgtggaccatatatcaaaacagccccgagggcacaattcatagtcgctgcaagtaggcaggactccactagtggagggctgaggatacgttcttgttaccatatactactcgataatggccaagacgaagacgtgccattagttcacgatatcatggacgcaaggattgctggtgaagcaaggaagacattgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453627 - DNA, 2851 bp, Homo sapiens
cgaacaagataatagtgtaacgacgccgtcaccgttatttcagtccgggccggtcttacttgaatactaggccctgttacaattaaatcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453628 - DNA, 2307 bp, Homo sapiens
gtggtcatagctagttccagagggatcccatgctgtatcacatgaccttgaaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453629 - DNA, 5191 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaaaaaaaaaaaaaaaaaaaaaaagggcggccgctcgcgatcagacactgagcttgtttttcccggttttgcaagatgtcccagtaaaagatttgaaaccacccatagtgaaagtctatgattactacgagacggatgagtttgcaattgctgagtacaatgctccttgcagcaaagatttttggaaatgcttgaagcccccaaggctgaaaagtgctttgctggagtcctgttttcaaagccccccaaaaaacacgtgtttttgtatctttaaaaacttgatgaataaaccctttttttggtcca

SEQ ID NO: 453630 - DNA, 1602 bp, Homo sapiens
  misc_feature (9)..(9): n is a, c, g, or t
  misc_feature (15)..(15): n is a, c, g, or t
cttagtgantgggtnatgtgtgcttcatcgatgaagatgtaggctcgagcttgggcaaaagtcttcagaacaaagctgtgagccaggtgttgcactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453631 - DNA, 1443 bp, Homo sapiens
gagggcggggcgaggggggggacggggaccgggcgtagctccccgtctggccgggggcaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453632 - DNA, 5127 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaaacacacagacaaccacacaaaaaaacaagaagactttgtttgggcccgccccgggccccggaaaaaagtttgtaaaacacccgctgtggggggcgggccccagtgttacgggcacatgggcccacctggtgccaagaaaaccgggcagcacagcggtcggttcccccataaaaagcccggggaacgcggtttcgaaacaccgagggctggagccccggctcccacagcgcacgaacaaa

SEQ ID NO: 453633 - DNA, 1424 bp, Homo sapiens
  misc_feature (196)..(196): n is a, c, g, or t
  misc_feature (211)..(211): n is a, c, g, or t
  misc_feature (213)..(213): n is a, c, g, or t
  misc_feature (216)..(216): n is a, c, g, or t
attggtcgtgataagtggtttatcctgggtagagttttgcaaagctgcgccaacctaaaaaaggaacaatgcttctgcttgcactgaacaggtttcttctccccccacgacacagtggtggctctccatgctctgtccaaatatggagcagccacatttaccaggactgggaaggctgcacaggtgactatccagncttcagggacatttncnagnaaattccaagtggacaacaacaacaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453634 - DNA, 5231 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaaggtaagccactcacactcctccaaaaggcagtcagagctccttcagcttgccccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453635 - DNA, 4780 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgaataataatgcggccaacaagtaatctcatatctttgcagccac

SEQ ID NO: 453636 - DNA, 4699 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtcaaattctagacacatgagcttgttcgtcaccggttactcaagagtggactactattgcggataacgaggatacatcaagac

SEQ ID NO: 453637 - DNA, 4616 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccttcagataaaatgggggatcctct

SEQ ID NO: 453638 - DNA, 4711 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatggtgtcaaatcagacactgagcttgttcttcacggttctgcaagatgtcccagtaagagatctgaaaccagccatagtgaaagtctatgattactacgagacggatgagtttgcaattgctgaataataatgcggccaacaagtaatctcatatctttgcagccac

SEQ ID NO: 453639 - DNA, 4520 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgacttctgtccggctcacatggttagatctttcaagcattttcact

SEQ ID NO: 453640 - DNA, 4966 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccaggtgagactcttgggcaggtgaggacaggacagatgaggacagcagctgttctctctgagaagtcctaactcagaaaacaatgggacagatcagagaaagggttagggacgtggacaggaattctgggaaagggcaaaaaactgattttgtctttgatgttctatagacatccttgaaatacaatattctcccagaaaaggaagagttcccctttgctttaggagtgcagactctgcctcaaacttgtgatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaat

SEQ ID NO: 453641 - DNA, 593 bp, Homo sapiens
tgcgggcgtctagaggatccctactctgaaagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453642 - DNA, 620 bp, Homo sapiens
agacacaggctcaagatgggaagaagaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453643 - DNA, 4065 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactgtaggtaccaccccattcctctgctgaaggagagttctggatgcaatgaaactgctgacctgctgtctgaaatactatcctattaaaagcaaagcatcagctttctttctatgcaatgccagtgcttcccagatctacagagaatttggtcagcccattaagaaaggtttaaattttcccagtaattcccctaggctatttaccaccaccactcaaaaaagaatcttaaagatgtatcttttgaatgtgagaataacagataaaaataatattatatctattgataagaatgaggaatcgttggaaaaatgcgtttgaaaaacttctgtgctgtgatccgtgtatttgcctgggaatgctaa

SEQ ID NO: 453644 - DNA, 3038 bp, Homo sapiens
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgccacacctcctaacatctatgtactggattatctatgcacagcagcttctt

SEQ ID NO: 453645 - DNA, 2513 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatggtaaacaaaaaattaataaatatatattgcctaata

SEQ ID NO: 453646 - DNA, 2395 bp, Homo sapiens
  misc_feature (2303)..(2303): n is a, c, g, or t
  misc_feature (2309)..(2309): n is a, c, g, or t
  misc_feature (2316)..(2316): n is a, c, g, or t
  misc_feature (2333)..(2333): n is a, c, g, or t
  misc_feature (2336)..(2337): n is a, c, g, or t
  misc_feature (2342)..(2343): n is a, c, g, or t
  misc_feature (2347)..(2347): n is a, c, g, or t
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtagtcagatgtaatgggaagaggccatgcacgcctggtgcatgttgaagagcctcacacggagaccgtacgaaagtacttccctgagacatggatctgggatttggtggtggtaaacacacgtgtggcngaggangagtacnagtcctggcacccattnccnntgggnngggncctttcctgtttgaagatcttgcttgggttcttttctgcccttttcgg

SEQ ID NO: 453647 - DNA, 682 bp, Homo sapiens
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacatggcagagtttccagcaggggtgcctagtgggccgagctcga

SEQ ID NO: 453648 - DNA, 1998 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccccgtgagttccacacagagagcgtgaagcatgaacctagagtccttcatttattgcagatttttctttatatcattcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaacaaacatggaacaatgccctggagtataaaaatctatagagtgccaaataaaggaacaatttgaaatactggtgttgatattgaaaaagcagggactctaatgtcagaagagaaatcctttggcagatgaggtggtgatgaattctttgtttcaacacaactgaaggaggaactgaaggaaataccaggtgatgagtgatgagaagggattcttgataatagagtactaggtgattttggcatgtaagtgcagaagttgcaagaaggtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacagctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcacc

SEQ ID NO: 453649 - DNA, 87 bp, Homo sapiens
atagtcctagcttctgggtcatagagctgtttagaaagatataatgcagaaataattttcatatgtctgatttgcttatttctctag

SEQ ID NO: 453650 - DNA, 162 bp, Homo sapiens
atatatattttgtccatattgcatcttataaaatctaggatttcttaatcaaatcagaaatcagaagacaagaggccgtgcagatgcttctcaattacgatggggttatatcctgacaaactcattgtaaagtctaaaaaatcttaagtgggaccattgtaa

SEQ ID NO: 453651 - DNA, 364 bp, Homo sapiens
aaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcaccagaggaccatttttggatggagccattgtctaatcatgagctgaaaggcaaatatttaaaatgcaaacatccatggttaggtaacactcttaaggaccttattagctgcttaccacaactgagactgtgaagtaatggctcac

SEQ ID NO: 453652 - DNA, 480 bp, Homo sapiens
gataaaaataatattatatctattgataagaatgaggaatcgttggaaaaatgcgtttgaaaaacttctgtgctgtgatccgtgtatttgcctgggaatgctaatatgcctgtttacatagcttagttcccttcttgttctgccttcacagcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaaggtgagagcacacctgagatccttctcctggcccatcctctgtatcaagaactgcatggcaaaaatccctcactcctacctcctgtgatccctgtctcctctcttcttttctatatatcatatatattttgtccatattgcatcttata

SEQ ID NO: 453653 - DNA, 406 bp, Homo sapiens
ccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtca

SEQ ID NO: 453654 - DNA, 594 bp, Homo sapiens
taattgcatcagagctaaaaaattttgtgcaaatttaattctaagatttccagaaaatgggcataaggacctaatacaaccaaggactgcacagattgcctgtaagagatccctcactggttagcaatcctgagttaaatacagattcagtcaggcccactatacacaatagtagtagaatttaaaattataaagcagccctcagtgaaatagcattttagagaagagaacttaagaacaatctcaaactgcatgttaaatttataactatattgtctgtaaaagattatgctacaattctgatatactacaattaaaaacagttggaagaaaaggacttatattcccatctcaatccttgattatactctccattattggtatttctattgagtgtttttaagtcatggcagtagaatcattcctagggattctctccctagaaaggatgtatttaactgcttactttctgttcttcacttacactcctctccagctcagcaggtgtggctgaggtaggagtaacagtccctgacaccatcaccgagtggaaggcaggggccttctgcctgtctgaagatgctggacttggta

SEQ ID NO: 453655 - DNA, 474 bp, Homo sapiens
tggcttcctctcattctctttgtgccccagtgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtgtgtgttttagatcataaaatcttcaacatgtaaaactagaagttactattgttatcatttgttttacacatgtgaacattagggccaaaagggttaaacaaattccccagagacattcagcaaggtagtggcagagtcacactaagaagcagaatcacttgattccttatacaaaactctcaaacttctcctagcagtgcctcttaccaattacacagttcagagtatgttattcccttcttctatgatgaaacgttgggaaatatgtaagcaagtttttaagactactaaggagcca

SEQ ID NO: 453656 - DNA, 408 bp, Homo sapiens
gtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtgagtgtggctgtttgacttaatatacttggttcttttagtcagggtcatagggatctagtattctgtcagatgaggctttgggaggttggtaagaactgcaggaaggaatccaaatgtagcaaactaagtatagaaattaaggagcaatgcatgactctccagccatgggagacaaatatttacaggcaaactaaaagtcagcttaataatcacatagaaaccct

SEQ ID NO: 453657 - DNA, 594 bp, Homo sapiens
caatatctcagaaacttgtcattaaaggagaagccttcaaactcccatagagctagatggctataactcatctcctctactcaccctttactactaccccatttgacctttttgtagataacttagggtttccatagatatcttttattagctccaatgctccaggtgcttttgtaagttataattaatttactcatataggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttggtatggatcatgaaaagtcatcaagcattatttttcttcatatttaaactcttaggtcctggaatttaagttcatttggagtctttccatttcccatgggtgacattgggcttggagtagaattaattacacctaagtccaatgaggacatcagtgatctgtgaataggacttcacatagcttcgttattttctgtagcaatatttaataccaacccccaaaat

SEQ ID NO: 453658 - DNA, 763 bp, Homo sapiens
gaagaagcctacagacaggacaacttcaaaaaggaaagatcttcttcccctggatgttccccaggcaaagttcctataatcttggttccttaatagcttgtcttaccagcctacaggcctactttgggtttgggggctcatgaaaaatatttctgtttcagtgaaatttcgtgttgtctccatggatgaaaactttcaccccctgaatgagttggtgagttttctattatctacataaaatgattgtctgtataaacaggctgggaacctgttttttgtgctgagggaagaccagggagaggaagaatctggtatcattaacagtaacttctggcattacaacagcacaagatcctaatctaaaacatcattccaggtaaagaaagtaggtaattctttctgtcttggtgctggtactcagtcagttgtcacacaattaaatttacttttcggatggttcttaattaggacaattagaaagatacattcaatagcagacacagaaaaatcctcaaagaacctaagctcaaaaaacattttaaagatttagattttttctatacacatctaccaaaatcttcactataaaggaaagtcagggtaattaatttgttcctcaagactaactcttggtatctgtgataagaaacagttctttctattgtaatgcagacatcaacccaaagtcttcatttttctctcccaaattaacttcttcacattttcttatctcaaaaagaggcaactcttctcttctagctcc

SEQ ID NO: 453659 - DNA, 688 bp, Homo sapiens
gggggaggccttctccaggaacttttcgccgcatgccaggcctgataacatctttgaatacgacgggtatcgtcctgccgtccagagtggggacgttcactgtgcagccacacagagccttgaaaagcaaaaggacagcattagatggaagctggctcaagaggctcagctcttgcccagaggccatctgccatagataagacccatcaggcctctgcagctaagacctggcccccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453660 - DNA, 1706 bp, Homo sapiens
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaacctattgcagatttttctttatatcattcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaacaaacatggaacaatgccctggagtataaaaatctatagagtgccaaataaaggaacaatttgaaatactggtgttgatattgaaaaagcagggactctaatgtcagaagagaaatcctttggcagatgaggtggtgatgaattctttgtttcaacacaactgaaggaggaactgaaggaaataccaggtgatgagtgatgagaagggattcttgataatagagtactaggtgattttggcatgtaagtgcagaagttgcaagaaggtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacagctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcacc

SEQ ID NO: 453661 - DNA, 4888 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453662 - DNA, 4834 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453663 - DNA, 3066 bp, Homo sapiens
tgagattattcagctattcgttcctggtgaatcgaacaccgcagacctcgcaggcaaagggcttctcgcctgtgtgggtcctcatgtggcgaggcagtttgcctgccccaggaagatatagtgtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453664 - DNA, 2425 bp, Homo sapiens
tagcaggaccccgagttgaaatgtgtttgggaggggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453665 - DNA, 5364 bp, Homo sapiens
  misc_feature (5169)..(5169): n is a, c, g, or t
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaaaaaaaaaaaaaaaaaacaacaaaaaaaaaaaatcttttggggcgcgccctggggcctcggaaaaaggttttttaaaccccactccggttgggcgccgcgcgcccccgttgtggttactgacaccctggggcacaaaggggtcccccgggggaacaccggggcaggacgagggtgctggggtttctcccccccaaaaaaaaacgcgccggggggcaacccggagggtttgtaacacactccgaaagggaggtgggggggacctgcgggggccttaaccgggnggccaggggagccgaaataaatgccgcgcgcgcaggtgtgaacagcagacgcaaagccagagacacaagaacaagctagccgagccaacagcgacaagagacacgatagcgaaccgaacaacacaaaaccacataaagacaacgcacacacacggaacgcagcgagtacacacgaagagaacatgactgagacaa

SEQ ID NO: 453666 - DNA, 1457 bp, Homo sapiens
  misc_feature (5)..(5): n is a, c, g, or t
  misc_feature (18)..(18): n is a, c, g, or t
  misc_feature (56)..(56): n is a, c, g, or t
gcgancggggtggggggnggcggcggggggggggggaccggggggcggcggtaggngcggcacggggcgagcaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453667 - DNA, 5180 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcccaga

SEQ ID NO: 453668 - DNA, 4899 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtcataatataaatctaaataactgatgaataaaaaaaaacacggacaaaaagccaaatga

SEQ ID NO: 453669 - DNA, 4738 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacgggtgagtgagagtgattttca

SEQ ID NO: 453670 - DNA, 4801 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatccttgaaatacatattctcccagaaaaggaagagttcccctttgctttaggagtgcagactctgcctcaaacttgtgatgaacccaaccacaccagccaaccgtggactagt

SEQ ID NO: 453671 - DNA, 4819 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453672 - DNA, 4796 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagaaaaccctaatcctttcctctccctggagtcctcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaa

SEQ ID NO: 453673 - DNA, 4912 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccaggtgagactcttgggcaggtgaggacaggacagatgaggacagcagctgttctctctgagaagtcctaactcagaaaacaatgggacagatcagagaaagggttagggacgtggacaggaattctgggaaagggcaaaaaactgattttgtctttgatgttctatagacatccttgaaatacaatattctcccagatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaat

SEQ ID NO: 453674 - DNA, 3657 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcttctactcctccctttatggcattgttgagcagtgacccagagctcctgaaacagccattgtccttctgcctctgggagagccatatgagggcttggttaatgtgtgcttcatcggatgaagatgtcgagc

SEQ ID NO: 453675 - DNA, 2968 bp, Homo sapiens
aggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggtgagcaaaaaactgctaga

SEQ ID NO: 453676 - DNA, 2392 bp, Homo sapiens
  misc_feature (2300)..(2300): n is a, c, g, or t
  misc_feature (2306)..(2306): n is a, c, g, or t
  misc_feature (2313)..(2313): n is a, c, g, or t
  misc_feature (2330)..(2330): n is a, c, g, or t
  misc_feature (2333)..(2334): n is a, c, g, or t
  misc_feature (2339)..(2340): n is a, c, g, or t
  misc_feature (2344)..(2344): n is a, c, g, or t
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcccacacgtgtggcngaggangagtacnagtcctggcacccattnccnntgggnngggncctttcctgtttgaagatcttgcttgggttcttttctgcccttttcgg

SEQ ID NO: 453677 - DNA, 709 bp, Homo sapiens
  misc_feature (709)..(709): n is a, c, g, or t
cacgagagagagagagagagagagagagagagagagagagagagagagagagagagagagaggtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacatggcagagtttccagttagagggataaggctcccggagggtaaggctcccgcaggatcctctagatcan

SEQ ID NO: 453678 - DNA, 414 bp, Homo sapiens
aaaagctattgtggaataggatcttctacaaggatttaaatataatcctacagaagaggtatcaattatacaggggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccaaggtggaacacctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatga

SEQ ID NO: 453679 - DNA, 4569 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453680 - DNA, 4473 bp, Homo sapiens
cgcccccttccccctcggggtggaaacaaagggggttcggcgcgcggtgcggagcctgggggaaaagggaggagcgctccggtggtctggcgcgctgggctcgctagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453681 - DNA, 4323 bp, Homo sapiens
cgcccccttccccctcggggtggaaacaaagggggttcggcgcgcggtgcggagcctgggggaaaagggaggagcgctccggtggtctggcgcgctgggctcgctagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453682 - DNA, 5100 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453683 - DNA, 4930 bp, Homo sapiens
cgcccccttccccctcggggtggaaacaaagggggttcggcgcgcggtgcggagcctgggggaaaagggaggagcgctccggtggtctggcgcgctgggctcgctaggtttgtgctggcgaggggacggggtgggacgggcgacccggacccaagaagtgggaggaccgcgcgtgtcgcggcctagcggcgaggggagtcgcctgcgcgcgcagcggaggccagtgcgccggcgcatagggagcccgggtctgtgatcgccgaggcggggtgaggcggggtgcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagatatctcccggggccaattcagcatctctacctggccatcctaacaaggtgatttgtgaaaggagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453684 - DNA, 4678 bp, Homo sapiens
gcggccgccgcggtcgctgccgccgccgcctcagcagccgccgccgccgcgcactttcagcctcagtcgtcgtctcccaggccgggccccgccgagcttgggcccccgcgccgcccgcgccccccaccgccgccgccccggccggagcccgccgccacggaccgcctcagccctccgggccacgggcctctccgggcgggagcccagggtggcggcgcctgcggccgagcgccgggagcaggtagtgttggtgcttcttttcagtgccagtccatccatcacgaccacatttgtcatgatgacagtgacaagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453685 - DNA, 4800 bp, Homo sapiens
cgcccccttccccctcggggtggaaacaaagggggttcggcgcgcggtgcggagcctgggggaaaagggaggagcgctccggtggtctggcgcgctgggctcgctagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453686 - DNA, 1538 bp, Homo sapiens
cgcccccttccccctcggggtggaaacaaagggggttcggcgcgcggtgcggagcctgggggaaaagggaggagcgctccggtggtctggcgcgctgggctcgctaggtttgtgctggcgaggggacggggtgggacgggcgacccggacccaagaagtgggaggaccgcgcgtgtcgcggcctagcggcgaggggagtcgcctgcgcgcgcagcggaggccagtgcgccggcgcatagggagcccgggtctgtgatcgccgaggcggggtgaggcggggtgcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccagtaagtctctatctttgttctcattagatattactattaagcacaccagcctgaatttggttttgtaacttcccgactcttaccctctttagaggggctaactgcattatataagcaaacaaaatttaagagactgtctttgtagtttcactttcaagtaaaaaggccaattttattgcaataaaaatctcaataatatccttatagtaaccatttaagaaaattagctttataaccggatatatttttacattaattaacttatacatatatttggatatcctgagggtcaaaccatgttttctcatatg

SEQ ID NO: 453687 - DNA, 1146 bp, Homo sapiens
gtcctttaggatttcggaattaacaccagcagaaaaagttaccaataggtatatgggaaacaggaaggacgtggtgttcttgggctgtgctgttttgcctccaacagtttttgtaagagagatccattgccagaggcaacctttgccatctttatgttttgatgtttaaaattaatttttaatttctttcctgtcttcgctagcagaatcatcaaatacctagaaaatccagactatccttcataggcgtgattctccacattggtgcagctagccatgaactatccttttcttcctctttttcccagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaaggttagttgattacaatttatttcttaagttttcttccattggtagatttgtgagtatatttaacatcagaaaacattttttctgtaggcatttcataaacacatcaccacatatacacgtacattcactcacgaaaaagaaagttgcctagatttccagtaggttagaagagtttatttagcttatcattgacagatgaagaaatggaaagaggctaaaatgagtcgatgccattatatatgaaattagctacttaaggtacagattgttgtggactagcctgcgatcttgactattagaagatgcattttgtagttcataactgtaaggatatatggaagtcttagaaatgagctactccttttctactccattccttttccttctgtatcctcaaaggcaattaggagcttaattatgtttcttataaacccatggagacttggcacagtagtagctcatgcctataatcgcaacattttgggaagccaaag

SEQ ID NO: 453688 - DNA, 4867 bp, Homo sapiens
cgcccccttccccctcggggtggaaacaaagggggttcggcgcgcggtgcggagcctgggggaaaagggaggagcgctccggtggtctggcgcgctgggctcgctaggtttgtgctggcgaggggacggggtgggacgggcgacccggacccaagaagtgggaggaccgcgcgtgtcgcggcctagcggcgaggggagtcgcctgcgcgcgcagcggaggccagtgcgccggcgcatagggagcccgggtctgtgatcgccgaggcggggtgaggcggggtgcggcggggcgcggcggggcggggaggggcgtggccgggccgggcccctagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggatctggcgagctggccgcgggctgggcgagcagtcacaataggaggcggcggcccagcgaggatccgcgggagctgcccggcagggcggagcctcccctcgcagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453689 - DNA, 4419 bp, Homo sapiens
cggaacccggtcgaaagggtcctctctggcgtccttctgcttccgtgggtttctggataggctgcgttttgttctcaggggatgcaagttcttcctttcagggttgaagcgtgagagaggttggtttttgaaacgggagtgtttcaggttattgaggtccaaaaagaaataaagtttttgtttacgtctgtatggcttgtaagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453690 - DNA, 4485 bp, Homo sapiens
cgcccccttccccctcggggtggaaacaaagggggttcggcgcgcggtgcggagcctgggggaaaagggaggagcgctccggtggtctggcgcgctgggctcgctaggtttgtgctggcgaggggacggggtgggacgggcgacccggacccaagaagtgggaggaccgcgcgtgtcgcggcctagcggcgaggggagtcgcctgcgcgcgcagcggaggccagtgcgccggcgcatagggagcccgggtctgtgatcgccgaggcgggagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453691 - DNA, 4674 bp, Homo sapiens
gtcctttaggatttcggaattaacaccagcagaaaaagttaccaataggtatatgggaaacaggaaggacgtggtgttcttgggctgtgctgttttgcctccaacagtttttgtaagagagatccattgccagaggcaacctttgccatctttatgttttgatgtttaaaattaatttttaatttctttcctgtcttcgctagcagaatcatcaaatacctagaaaatccagactatccttcataggcgtgattctccacattggtgcagctagccatgaactatccttttcttcctctttttcccagatatctcccggggccaattcagcatctctacctggccatcctaacaaggtgatttgtgaaagggtgagacttcagagcctgttccctctcctcccaagtgatcagaacactaccgttcaagaggatgctcacttcaaagctttcttccagagtgaagatagtccaagtcctaagagacagcgcctctctcattcagtctttgattatacatcagcatcaccagctccctcaccaccaatgcgaccatgggagatgacatcaaataggcagcccccttcagttcgaccaagccaacatcacttctcaggggaacgatgcaacacacctgcacgcaacagaagaagtcctcctgtcaggcgccagagaggaagaagggatcgtctgtctcgacataattccattagtcaagatgaaaactatcaccatctcccttacgcacagcagcaagcaatagaggagcctcgagccttccaccctccgaatgtatctccccgtctgctacatcctgctgctcatccaccccagcagaatgcagtcatggttgacatacatgatcagctccatcaaggaacagtccctgtttcttacacagtaacaacagtggcaccacatgggattccactctgcacaggccagcacatccctgcttgtagtacacagcaggtcccaggatgctctgtggttttcagtggacagcacctccctgtctgtagtgtgcctcctccaatgcttcaggcatgttcagttcagcacttaccagtaccatatgctgcattcccaccccttatttctagtgatccatttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaacatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453692 - DNA, 4410 bp, Homo sapiens
ttaggcatttcatctgggtattttcaggctccagtccaggcctggccttccacatctggtgctttaatatctacctgggacctctgatgtccacatctggaacctgcatttcaccctctatctttggtgcagagatatctacatttcctttcattttgggtcctttaagatccaggtcaacatctggcaaagacatcttaggagctctgaagtgcatctcaggcatcttaaacttcgggccataacccctatccacttctctctctcgtcgctaccaacaccaccctctacactgcaattgacctgaaggatgccttcttatacatcctcctcacctttctccccatcatcctcctcatttgccaccaccaggccagtttgtccctttccaaacacagcaatcacgatcgcctctgcaaaggatagaaaatgaagtggaactcttaggagaacatcttccagtaggaggttttacttaccctccatcagcccaccccccaacattacctccatcagctcccttgcagttcttaacacatgatcctttgcatcaggaggtgtcctttggagtaccttatcctccatttatgcctcggaggcttacaggacgtagtagataccgatcccagcagccaataccacctcccccttatcatcccagcttactgccatatgtgttatcaatgcttccagtgccacctgcagtgggcccaactttcagctttgaattagatgtagaagatggagaagtagaaaattacgaggccctgttaaacctggcagagcgactgggagaggcaaagcctcgtggactgactaaagcagatattgaacaacttccttcttatcggttcaatcctaacaaccaccagtcagaacagactttgtgtgtagtatgcatgtgtgattttgagtcaaggcagctacttagagtcttaccctgtaaccacgagttccatgccaagtgtgttgacaaatggcttaaggcaaatcgtacttgcccaatttgccgagctgatgcttcagaagtgcatcgggattcagaatgaccaacctaagaagcacaaatttagtttgggtgttcctcatcacatgtatatacggactatccattgaacttaatctgtgtggcttccagccctccctttaccaaaagggtcaatggacctttctttgcactgtgtgacttaatcaactataaaagcttacaattagtcttcacagttatgggattgttatactaaccgtgtgattggaactccaaagactttttctttagcttaattttgtgtgtgcactaacattccctggtttttgtgtgatcattccgagtgttgctgcaagattacagtggacgtgatcttttagcatgtgcttttataaaaagtggtagctacagatgatatagcaatctaccttatatagagccttcagaaactgtgagtggaaatgaatgcgcagcgtatgactgttggtgataagtgtatctgtgtgagtgtgtgcaactacttgtgtgagggcatggtagctaacgtgtgtatgagatcctatataccagcatgtaccaagaatgtgtgtgtagttttaattatgctgcaatgtataatctggtgtgttatttaaacagcactagtactgtacactggtttttttcccttgtgtttgctgttgcacactgattgctgagggtgcatcaattacaagcattgaatactccatccccttccctcccagtgaatggaatgagaaaagccttcttcctttgcttcaggcagctgtcaccttctctttattggtggtcctaagtgggtcacttaagaaaaaaaagtgtaacaaattctcactccatgaacctggtttttttttattctgttgtggaaatttttaaatctccaacttgctgtttccaaaaagaaggtgcaatatcatatatcatcagttagcaatattagcatttcaatcagtgatttgaatgttgatacttttttttcctttacatttccagtaagtttcttacagaaagtacctgtgattttttttaatgtttagatttgtagtctagtctattctgaagatatttgattaatatatttctaagaagaccactagtcccatgaagtctcaccttgttgacttccaccagaacaaaacctgttaattcagcttgacttctcatatgtgttctgtgttcaagctcctgtgggcaactcaattgttttaagaaaactctatttctgttcatattaattcacttgccagactccaattctgaaagttgtctagttcttccttcatcacacgtgcttctcatcgaaaccctggtttcaggatggatcaagtgctgttacagctcatgttccttagacctgatttgttttgatattttactgcctttccttttaatttttgtttgaatgagaaaagtttaatacaacaggtgtccagaatacttgcagtataaatgaagatttggtttttgtataaaaaaataatgctgttaaacaggagttgaccttcatttagttgatgtaatacatagctgtatggggttttttttagtaagttctttgagcataattcactttaaagtcatttttccagcaatgtttaaattactttctcattcttttagtgtattcaacattgtctgcctcttcctgcagttgatgtaattgctttgtttgcaatagcacaagctgcattattccagtcaggactgtgataacttgctgccagccccactcaactttcagttggctctgtgtcagttttccactcagtgttaactacttgttactgccatgctgcttgccctcccttgaagtgtctataagctcatcacagcctagagttaagtaaagtcaattcacagaagcacaattttgccctttgcgagacattgttgcctctatctagtcctacaagtagggttttgcatactgtgtttgcccctagggttgtcagtgcatcagaaatacttctaaatagtggtaaaaatgcacatggttaatgcacatgttacttttaaatcattaggatatccctcacctgttcctgatgaataaaaagtgtgttaaagaccaaaattcttggcataataatcagctacatacaaatcacatatagtttaatcttttttaatgaaaaaaaaatcatgtttaaaatggcaaaagcccatcttatacacttttatatagctgcaaaaaatttatatctgtacagatctaacactacgacactcagtattcattttattgaagcatgcaagtaaagcactttttctaatttatatagaggtatctaattaacacagcacattgtactaatgactaggagtagcagctttttcttctctccctctatgaattcttataatgtccctttttctgtaagtttttgagaggcaattggcaatttaggaggcagcagggtctgttttggtcaaatcttgaatttcgttgttgcactctagtgactgatctttgggaatgtcttgtctttgcatggggctcatagagatgtgtgcagacttgcttattgtggttagtgtgtatcaggaacacacacacaggtgttctgaccagctcaggcttgccacagtgagcaactctgtggctagcaaaagagaagtttatttgtgcccagccattggtcaccttgggtgatgcaccagatagcaggcagatgttggttcattggccttcgtcctctttcctcctaaaataatattggctttaccatcttaactcagctgtgggttttttgtgggttcttgtttgttttttggcatgaattgtcatctttggtgtttttttaacccccagcccctcaaaaaaataaggcctccaggtatcaagatctcatattaggattttctgtccttaattttttgagcaaaatctggaaaatgtgaaagcatatttagattttatatactatctgaaatgtgatttgttaagattcttaaatttgggcctcttagaataattttgaatgagatctaccgactcacttgtgagaatatttttcacagattatctttgggccttttcattagaaagctgtttgtttgtccccctgttggtacatttggttacctcattttgccgtttcagattgtgaaagctcacaggggtgttttttggaatcatttgctgagtcattttctcaaatcatattccattgtatcagttaacatatagttttaaatgtatgtattataaatatctgtaaccaaatcatttgaaggcttgataaatttttaacaaagtttgtacattttttatgaaagttactagtaatgctttactaagtagtgcaatgaatttttatttttaatccctgtgcccaattttggagttgagagggttgttggtaataaatgtatgatgtacacttaaaaaaaaaaat

SEQ ID NO: 453693 - DNA, 408 bp, Homo sapiens
ccaaggcagcacagcagagatttgtacgagagaagacatggctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453694 - DNA, 1001 bp, Homo sapiens
ggggcagctgaaaactttccacaggctgcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtcccggagggatctggcaacttggcgtgatggcggcgtggtgtcgggtggctgtctgtggtggcggagtggtcttttccccgcgggagacccgtgccccgcccgggggtgtcgcccgtgcatcgagtccctgatttgccctttggccccgggtggctccgaccccgtccgcagggcgaggggcgcgcgactcagggggcgaagtggtgcccctcc

SEQ ID NO: 453695 - DNA, 2896 bp, Homo sapiens
tattcatgcgggggcgggggcttagctcgtagatatcgtgggcacctcggcggtcaatttcatagcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453696 - DNA, 2562 bp, Homo sapiens
ggcaaggaagtggtactgctggactttgccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453697 - DNA, 3841 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453698 - DNA, 1958 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453699 - DNA, 3822 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453700 - DNA, 3373 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggaagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453701 - DNA, 3372 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggaagagggtgtcaaacattcgtgagctggggactcagggaccggtgctgcaggagtgtcctgcccatgccccagtcggccccatctctcatccttttggataagtttctattctgtcagtgctcaagcctatgaaatagaagaacgtatgtttccggtccttatgcataattttgtaattattcactgtcatatcaggactgcttcatgctttggaatacattttcacctgattct

SEQ ID NO: 453702 - DNA, 1561 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacaggctggagtgcaatggcacaatcttggctcaccgcaacctctgcatcccggattcaagtgattctcctgcctcagcctcctgagtggctgggattacaggcatgcgccaccatgcccagctaataaaagta

SEQ ID NO: 453703 - DNA, 1432 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccagggtgagtgacggttctgggttgcagggaagggggttctgcattcccaggttctggtctttagctttggaatcatggaatcttggtaagctcatccctgctttgacacacattagttctgttagtggaaattatagatccttcccagacatcagtttccttattaaggctggactaactcattcattaagaatgaatgaattgtggctgggcacggtggctcatgcctgtaatcccagcactttgggaggctgaggtgggtggatcacttgagcccaggagtttgagaccagcctgggcaacataatgaaacgccgtctctaccaaaaacacaaaaattagctgggtgtggtggcatgcacctgtaatcccagctacttgggaggctgaagcacgagaatcaattgcttgaacccgggaggtggaggatgcagtaagctgagatcgcaccactgtactccagcctggggtgacagaggagatgcttgtctga

SEQ ID NO: 453704 - DNA, 419 bp, Homo sapiens
gtcctggctcgctcacttcctccctgttcctccacccgccttctccgcaccctcggccctgagagtggagcttgggcagcaaaagcggggactgggccgcattctgagcaccccaggtcctcctaggaccaaagtagggccaggaggcttccctggccggagcagacctcactgacctccctgcatttggttccccgtggggctctttcaggaggaagaaccagcgtgcccgccagtccccggaggacgtttacttctccaagtcaggtgagacgcagcccccgctccaggcccagccctgcccgcaccgtccccagctctgtgggggaggtgggggcagccagggtgttcccagggcactggggtggggccacaggcttccgtgggcagctctgaggggtccgtcccccacagcctgg

SEQ ID NO: 453705 - DNA, 3924 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453706 - DNA, 494 bp, Homo sapiens
ccagaggcaccaaggaggccagaggcaccaaggaggccagaggcaccaaggaggccagaggcaccaaggaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatgtgaggcttggggcctgcccacactgggtggagaggggccacttagcaggggctctgtctgtgactgtgcccacctcccctatacctgtgcccaccttccccccacacctgcacccacctcctctacaactgtgcccacttctccccaatacctgtacccacctcct

SEQ ID NO: 453707 - DNA, 2567 bp, Homo sapiens
ctcgctttcagaagtcacagagctgccaggtttggggttttgcccccgcagatgctgcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453708 - DNA, 1610 bp, Homo sapiens
acgctaggtagaggctgggtgtgaattggcgaggcacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453709 - DNA, 1000 bp, Homo sapiens
ggatctaagatcccctcctacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatataggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 453710 - DNA, 3369 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggaagagggtgtcaaacattcgtgagctggggactcagggaccggtgctgcaggagtgtcctgcccatgccccagtcggccccatctctcatccttcgcattagtttcccttcccagagtgttgggtcaggaagaaacctggcattaggttgggatttgtatttgaataggagccccaggcaagggtaggaacaggttttaaatcagaggcggcaggtaaaagtcgattttttc

SEQ ID NO: 453711 - DNA, 2759 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgagtggatgaagccatcatgatgggttcgggtcccaaccatgtattgcccttcgctttacaggtcttgatgcgtgtgggcggacgtgccgcgcccagttgtgctctcggtctggcacctccttggcctgtcctcagacgtgttgcccccagggtcgggggcccccggc

SEQ ID NO: 453712 - DNA, 1915 bp, Homo sapiens
gaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtcccggagggatctggcaacttggcgtgatggcggcgtggtgtcgggtggctgtctgtggtggcggagtggtcttttccccgcgggagacccgtgccccgcccgggggtgtcgcccgtgcatcgagtccctgatttgccctttggccccgggtggctccgaccccgtccgcagggcgaggggcgcgcgactcagggggcgaagtggtgcccctcc

SEQ ID NO: 453713 - DNA, 3012 bp, Homo sapiens
agcggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggcacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgatttttttttgtaggttttttttttttggtttttggtttggtttggttttgttttggagagggagtctcactttgtgccctagactgggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatatgggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagcatctcagaatgtgatctgattaggaaataaggtcattgcagatataattagttcagatgaggtcattcatgtgggccctaatccaataggatgtgtgtcttataaaagtttgtacagagacccagacacacagaaatgacaccatgtggaggtgaaggcagagattggggtgacgcctctacaaaccgaggaaaaccaaagctgccggcacaccctcagaagccagagaccggggactcatcctccctcacagcctcaggagcagccagggctgacaccctcatctcagacttctgacctccagcactgggagaccttcagtttttgtgatttaagccactaattttgaggactcacatgtgaccctaatgccgccatcaccttaactccgaggccagagtctacactacagcttccctctccccgcatccagactacatcccgcaaatacaccagtgaacctggtaccaaggtgatgggggacaggtcaaggccaagagatcagagccacaaagacaaacccggtcagagggaaaaaga

SEQ ID NO: 453714 - DNA, 2446 bp, Homo sapiens
  misc_feature (2431)..(2432): n is a, c, g, or t
agcggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggcacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgatttttttttgtaggttttttttttttggtttttggtttggtttggttttgttttggagagggagtctcactttgtgccctagactgggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatatgggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtcaacccnngctgtgtggggagg

SEQ ID NO: 453715 - DNA, 2472 bp, Homo sapiens
agcggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggcacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgatttttttttgtaggttttttttttttggtttttggtttggtttggttttgttttggagagggagtctcactttgtgccctagactgggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatatgggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagc

SEQ ID NO: 453716 - DNA, 3055 bp, Homo sapiens
agcggaggtggcccatgtcctgcaagggccttgctgatgggatgtcctgaagggctgggcagccttagatcgggctaagagggcaggactgtgggccagtgccagagccaggcttgtctgttctcaaaggatcagcctcctttggaggacattttgtgtcaaggatagggctgaggacctgcgttctgaacgtctttcctgggattcttgacagccaaagaaattcgaggatcgcctctatgaaggtgaagtcttggcatgtggggtacccctgaatcctgggctaaggtctgtgaccttttgccctccagttggggtatgtgtggtgtccccaaagaacaagggctcgtggatcccgagcagggtgcgatggcggattgggaggtcccatgtcactctcccatgcccgcctttgaagctgaggcgctctttagttaacaaactacaagtcccagcagggaccgggacgcgggtgggagaggcgcctgtggccccgaggcgtgccgcgagttgtagtccctcctgcccgctgtgttcgcttttgagctctccgatgggatgcggcgcttcggaatttcgggctttgatccctgtcccgcccttggcacaggcacctgccggcctgaaggcccccgcggtgggggtaccctgcgcccctccgcgggaaggtggactacagttatcggcaggctgtgcggcgccaaagccacggtgacccagacccgaggtttttccgggcgtcgcagtttcccgagactccgtggcggcgtttgtcttctttttcttagtcagatcccgtacttttgtggagggtagaggaggctttgaccgccgcggccccgggggctggtgggaaatggagttccaaatgagaaaatagaattccccacttctctttcccacaggtgccagggaaacggagtcatcgacccaagaaggtcgtgggagatgaggtcccagggtaaacagcgggtcccgccactatgtcaccctttcctgccgcctccccggatgaactgcatgcagggcggccggctccgtggcaggcagaggcaggaagaggcgcggagcccgctggtggcgaagaggggagtgcggcgggaggggagggcagaggcaggcggccggtcgcgtggggcctgggccgccccaggagggcctctggctggattcttagcagatggaagccgtgcaagggcaggaggcaggggcctgacgtgtttggattgaggttgcaggaggggcccctggctgcttcagggagaataatttggaggcgagcggggaggtgagaggaagctgtgcggtgcaggatggcgtggctgtggaggtggagaacgttgggccacgctaggagtcttgaaagaggagccaaaaggacttgctgagagccgccgcagctggtgaatgacggtgccatgactgaggtggtcgaaagggagtatttaaggggaaatcaggcattccgttttgaccaaattaagctggagatgcctgtggaacattccagccaggctgcatcacgtcacactgaccttcagcattgcccacagtccatcttcccccaggacctgaggattttgcgtccggctccctcctcgcccaggacccccaagctcccagcacgcttctgatttttttttgtaggttttttttttttggtttttggtttggtttggttttgttttggagagggagtctcactttgtgccctagactgggagtgcaatggcgccatctcggcttactgcaacctccacctcccaggtgcaagcgattcccctgcctcagcttcccgagtagctgggattacagatgtgagccaccgtacccagctaatttttgtatttttagtagagacggggtttcaccatatgggccaagctggtctcgaactcctgacctcaggcgatccatctgtctcagcctcccaaagtgctgggattacaggtgtgagccaccgcgccaggcctcagcccacttcttttgggtggcaatggtttggatatcgtttgtcctcactaaaattcatgttgagattcgagccccagtgtggcaggtgttgggatgtggggcctcataggagctgtgtggtcttggaggtggagtcctcatggatagattaatgcctgccttaaggggtgagtgagtgctcacccttgggaatttgggaatttggttttctctcccttgcttccttcagcaccatgtgatctctgtgcacacagctgcatccttctgccctcccccagaagcagcagcagcctcagggatgagggaggtcctcagtgagtgcacctgcccagtcttgaaccttccagccatcagaatctgagccaaatcaacctcttcctttataaagacccagcctcaggtcttctgtcagagcaacacaaaatggactcagcacggatcaaattgtgtctcccccacccccacaaaaaactttatattaaaatcctaacccccagcatctcagaatgtgatctgattaggaaataaggtcattgcagatataattagttcagatgaggtcattcatgtgggccctaatccaataggatgtgtgtcttataaaagtttgtacagagacccagacacacagaaatgacaccatgtggaggtgaaggcagagattggggtgacgcctctacaaaccgaggaaaaccaaagctgccggcacaccctcagaagccagagaccggggactcatcctccctcacagcctcaggagcagccagggctgacaccctcatctcagacttctgacctccagcactgggagaccttcagtttttgtgatttaagccactaattttgaggactcacatgtgaccctaatgccgccatcaccttaactccgaggccagagtctacactacagcctccctaacagagggaaggggctgggttcccaccccttgctccttccctctccccgcatccagactacatcccgcaaatacaccagtgaacctggtaccaaggtgatgggggacaggtcaaggccaagagatcagagccacaaagacaaacccggtcagagggaaaaaga

SEQ ID NO: 453717 - DNA, 684 bp, Homo sapiens
  misc_feature (672)..(672): n is a, c, g, or t
catgaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagtcgggcagaaggtacggctgatcgatcgagggttaaaaaaagngccacaaaacaa

SEQ ID NO: 453718 - DNA, 441 bp, Homo sapiens
catgaggaagcggggcagccggcagctcccagactggagatgctctggggaaagcacttgcttcggtgaggaaatattgactttggactccatatgtaccattgtaaagggtgaactttaatcagaagtggacatttggaattttagaaaatgaatggcaaatagctttgatttttggaaaatgctagctttcttgcataacagtcactggaaaatttgagaaggctctgaagcttccagtatatagtctctttctctcatcctcaaaatggtactaagctgcactcaattatggatgtgggaatattctcctggtctttgggtttataggttttttatactgatgtcttatttttctctaaagtaatatgggtgcacattgaccagctaagactgtcttagcaaggaatagttctaaaacactttgaaagaggcatttga

SEQ ID NO: 453719 - DNA, 7494 bp, Homo sapiens
  misc_feature (1217)..(1217): n is a, c, g, or t
catgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggctttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcatccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgngagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcaaaaaaaat

SEQ ID NO: 453720 - DNA, 6800 bp, Homo sapiens
catgaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcaaaaaaaat

SEQ ID NO: 453721 - DNA, 6937 bp, Homo sapiens
acacctaggcgcacttctgcacccaggcgcacttctgcacccaggcgcacttctgcacccaggcgcacttctgcacccaggcgcacttctgcacccaggcgcacttctgcacccaggcccacttcttaatcatggcctcagttccgaaaaccaacaaaatagaaccgcggtcagaagtgcgcctgggtgcgcacccaggcgcatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcaaaaaaaat

SEQ ID NO: 453722 - DNA, 6788 bp, Homo sapiens
gtacccactagtccacggttggctagtgtgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcaaaaaaaat

SEQ ID NO: 453723 - DNA, 6366 bp, Homo sapiens
  misc_feature (1217)..(1217): n is a, c, g, or t
catgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggctttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcatccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgngagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttata

SEQ ID NO: 453724 - DNA, 6098 bp, Homo sapiens
  misc_feature (1217)..(1217): n is a, c, g, or t
catgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggctttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcatccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgngagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgtta

SEQ ID NO: 453725 - DNA, 6214 bp, Homo sapiens
catgaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggacctgacaccagagcagaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaaaaaaaaaagataaacagttacaccttgttttcaatgtgtggctgagtgcctcgattttttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttataaactgtttctgacacttgtttcatttcattttgcattgtccatatagctatgattctcttctgtaagtaaaacgcatctatatttcattttccaagtgttggaggtattgacagcttaacaaacaaaacatacaaaaaaaatcacaaaaacaaattgaaaagcaaagcacatgattgatcaaggaagagatgcccttaatgaaaatggaacgggatgcatgcaaaacaaaaagaaaactgtctagaggattaactaattgaaggaatataattaatgtgtgtgtaacactgaagctatgcatttgaagagctctgaactgcaccagtgttttcggttgtgctgcaggttgctaagtcaagtcagccttaaccttttgcaccagttggtcggctgtttggcagaacattctcagatcttttcagtcaaaaatctaagatgatttattttgtatcactttgttaaaagctgaatattgttaactacagttaatattaacactgtatttatactttctcaaactacatccgccccaccacttctggttgcctctgttgactattaatccagatgtaaacaaccagatgtttttttctaacttgtacaaactgacgtgtgtcaactatcatggaaggaaaaaaatgtacagattaaaattattcagtgttatgtactgtaagttaatatttttgtagaatggacatcaatctactttgcaaaatttggaggctatttcaacattgcactgtagaaatgtaaagtaatgtatgcaatgtaaaggaaagcccgcggtagctgagcgcttcataacagaatgttctaatcaagtacgtggtatttggggatgtctccaatattgctcttgtattctttctaattgggtttagtgactagttgaaggaaaatgttataacgccatttggttcacatgtgaagtgccctccatagccaaatgttgggatttttttttttttcgtttttggttggactgtttgcagatatttaaattttatgaaatttccaaagattttggttgataacccccttttaccttctaaatgatttgagatgttcttatgttcttactgtgtgttttaaatatatataaaagagccacaagcaaaaaaaat

SEQ ID NO: 453726 - DNA, 797 bp, Homo sapiens
catgaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctagcaataatgacgatgaggaccccctccccgcttccctgcctcaccctcaataaataaattaattgttgtcatgg

SEQ ID NO: 453727 - DNA, 5641 bp, Homo sapiens
  misc_feature (1217)..(1217): n is a, c, g, or t
catgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggctttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcatccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgngagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataaga

SEQ ID NO: 453728 - DNA, 6309 bp, Homo sapiens
  misc_feature (1217)..(1217): n is a, c, g, or t
catgtttattcacaatagtcattcagagctttatagcacgtgctgctctgccttcttgagacaagacgtcgtgcacacttctcttttttacatgacagcccttggaatatttgaaccctgctgctgtgacgacttcctcatatgatatgctttccaggtggctcatcatcctctttgccttccattcaaaagtttctaatttgtcactgtaacactcagaaatggacagaaccgatcttatcttttcagactattctgggcccggccatgcatttgttatgaatcatggaatattttggttttcacaattagaaattaccttttggctttttttttttttttttttgtaagagacagagtctggctgtgttgcccaggctggagtgcagtggcctgatcacatctcactgtagcctccacctcctagattcaagtgagcctcccacctcagcctcctgagtagctgagaccgcaggtgtgcatcactgtgcccagctaatttttttttattttttgtagagacgaggtctcactatatcatccaggctggggttataggcatgagccactgcacccagctttctggcttcatttttgactcacaatgaggtcatggtcattcataagctgcaggtgtttggtttgttgaatcgttttgcatgactgatatcagttcaggtttcccaaacttgttctgtggatcataaacatctataagattaaagaccatggaagtcatgtttttgtaactttttgtttaatacatagagaaaatgagactcacatagtgggttgaccaggccttcaaagcaaggtaatggggacacctgaataaaagcctcactgtcttcactcccattgctctggtgtcttacatataggcctttcttcttactcctgttaagctgccttgtatttttttgacctatcaaaatcatttttcaattacttgtttcccctagatttcagatgtcacggtatgaaaggttttatatatatttaaaaaataaagtataaacataaagtctttttgaagcgtggttatgcaacatatgctaggcgtaagttggtgaatgcctgctttgcagagtgtaaccccattgaataaaaaaagctttgttttccctttctgcccccctgtatcagtatgggcacaccctgcactctaactttaatctacgtcaccctcacctgtttggtttgggtttaatgtctgngagaaaaccaaatatcttgtgtattgtgaactgtcaaagccatctaaaccaatcccaaggtcaagtggatataaaaattctgccaaaaacatggcataagatggaaaagttccctgaaaactctggaagaaaacaaagtaatgtagacaccttctttttccccacaccattagaaaatgttgcatcccttttgtcccacagcaataatgacgatgaggacctgacaccagagcagaaggcagagcgtgagaaggagcggaggatggccaacaatgcccgagagcgtctgcgggtccgtgacatcaacgaggctttcaaagagctcggccgcatggtgcagctccacctcaagagtgacaagccccagaccaagctcctgatcctccaccaggcggtggccgtcatcctcagtctggagcagcaagtccgagaaaggaatctgaatccgaaagctgcgtgtctgaaaagaagggaggaagagaaggtgtcctcagagcctccccctctctccttggccggcccacaccctggaatgggagacgcatcgaatcacatgggacagatgtaaaagggtccaagttgccacattgcttcattaaaacaagagaccacttccttaacagctgtattatcttaaacccacataaacacttctccttaacccccatttttgtaatataagacaagtctgagtagttatgaatcgcagacgcaagaggtttcagcattcccaattatcaaaaaacagaaaaacaaaaaaaagaaagaaaaaagtgcaacttgagggacgactttctttaacatatcattcagaatgtgcaaagcagtatgtacaggctgagacacagcccagagactgaacggcaatctttccacactgtggaacaatgcatttgtgcctaaacttcttttggaaaaaaaaaatataattaatttgtaagtctgaaaaaaaaatatttaatttaaaaaaaattgtaaacttgcaataatgaaaaagtgtacttctgaagaaaactacatgaacgtttttgttggtattcaagtcagctagtgtttataattactggatattgaattaggggaagctcggctgccctagtaacaaaaccagcaaacgtcctgatgacaacgaagtgatgacattagccattccttagggtaggaggaacagatggatcttatagacctatgacaaatatatatataaatatatatataaatatatattaaaaatttagtgactatggtaagcttttgttcatttgtttcagacttttttctcctgtaaaaaaatagtactgattaacttttttaaaagaaagattttactgtaaatatggatttttttttttttggtcttatttctgtccctttccctggtttgttatcgtaacctgtagtgccaactctgcttccagaggggtagtgcaggatgaaatgctgaccctgatgttgcttctcattcataaataagtagaaagttgtttctccagtcttttgggaacacaggacttaaaagtcacatcatgtgtagatattacaagcagcattaccaagacatggcaaaaagagtttgtctgaattgtaatgttgcgtttgtgaacctattctgggattttcagaggtacaaggttagaatgctacaatgttaccactgtgccttccaatgtttatatcatcggaaacataacataatcaaagtggctgtgatttaacaaaatgattaaagtgttacctacctgtgtagccgaagtagtgtgcagtgaggcgtttctgaatacatggtcagatttttggaaaaaaacaaaaacaaaaaaaacaagtaaagttcaaaaaccgtcaaatgagaaaattgcaagtagtgtgacagagctgattgattttgttgctttcttgattttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggccagtatgaatgaagtttatacttaccatatttgatagaaacatagatcaagctatggcacagcgactcatcagatagctagctttgacgtctgggcacaattgaaccaacttccatcgtgaatctttataatgattgactttggtgtatagtgcagtaaacaaatagtgctcctagttaagtatttgtcagcatccttttgtctctaacttgtttctatttttacagccacacaattcttggcatgtattaagaaaaaaaaaaatccctgttcaagtagtttttccacctatcagcactgagtaaatgccataaatccattgaaatggtctaaatgttccatctgttctcctgttttgccagttatatagtaatgaaatacatttgtaaattttatgcaacaaatggcaaacgtatcattattttgaaattgtgtatgtaaaagttatatttttacatgtagactcttgttattatgtgttttaatacattgtatcagtttttgtttttttttaaaaactgtggtttaaaaagaagtctcatttaaatgaaatagctacaagaatcagaattttatgttcatttctgaaaatgtaagaacaaataagatagttaccacgtggtcatcttttacaaacccataaacattttgattagctgtgtgtgtgttgaaaaactgtaaatatgttcagtagcgataaaactaaaataactttgatttgttgataagttcctaaaatgtggaggtggattaaaaccttaggagaatagcagaaatcaaacttcatgaaaagttattttggggctttcctgtgaaatgtatgaacaaagaggctcagagaaggacatggaagacaataatgtatactctctcctcctccctgaataatgaaaaccatgtgtatttgttccctccgtatgttaaagatttccttttagtggtacattctgcactcattttgtatagtctaccaaggcgggtatccctaggaacaatattatataggaagcaggtatactctgatcacattcaggataagtgtacagaagaaaatacggtgtttactctttagggaactggaaacactccctgcattgatgtacattttaagaatggcacttttgatacatgttatcataaaggtgcttaatagagctgaattaaagtttttcaaatctgtaaacaaagcaaaaaagtaaattgtagtcatttgattattttttaaattggtgctttatattttgttctcactcagagtaaaagctgcaatttattgttcaccagctttgatgtattcattactcagtaatgcaatacctctattgttgaattccctttggaaataagtgaaaattctaacggccactgaaagctgctcgctaggttttgcttggtggagaaacataatctgcacctatccatattaattgggttgtatccccattaaaaaagaaaaaaagggaatgtggcctttttagtgtgttttttattgttgttgttttgtaattatcaaacccaggtaagatattggtatcctgcactggattttcaaatgaagttcagcagaagacagttaagattaaagtactatacaaaaatttcaaaagggtccatactacgctatctgtatgacgacacttaggctggggatctctttcagaaactcggactttaaaagcaacttggagcagttgatccacctccacattcaagtaatttatgaatatgcagaatagggatctgttcatctagaaatttttaccatttgtcttctgtgtagctgcaaggaacactaatgtttatacaactgtcagtccacccagtggtgcaactggttctgattcagtcttccgattcctttttatttttcactttttcctatttctgaatttttttttttatttgtgatcttgattttgatgaggggttggggagtggggagggagtcgaaccaagacttggagttaagaggattttcatcttttgcatccaacaggcagaatatgatctgtgtccaaaagtgaacttgagtcaggaatgaatcaatttcagcataaacaagcacaaaaatttagtctgctggctgactggaagcaaaaaagtcaagatggaatatgatgaattccaacacaatggggcaccaaggcctttaggcctctctttttattttgctttggttttgtttgtttttctttagagacatgctctttctcatgggacttgaagtggactcatctttgtgcagtgctggttttgccatactcatttcaagtattatagacatatgtaatggtgaaaatatatgaactgtggcctttttcattcttgttacttgtgatgcaattaagtgaagataagaaaaaaaaaaaaaaagcagagatttaccatgtatcagtgcctggctttttgttataaagctttgtttgtctagtgctcttttgctataaaatagactgtagtacaccctagtaggaaaaaaaaaaaactaaatttaaaaataaaaaatatatttggcttatttttcgcaggagcaatccttttataccatgaatattacaaaaaaattgtcagattctgaatatttcttctttgtagatttttggaatcattatgagtaaaagtttgttactttattttactatttaaaagatgttattttaccatgtgttaccaagatgaaactgtatgggtagcttttttgtttgttttttgttttgtttttgtttttgtttttgtttttagttgtaggtcgcagcggggaaattttttgcgactgtacacatagctgcagcattaaaaacttaaaaaaattgttaaaaaaaaaaaaagggaaaacatttcaaaaaaatttcatgtttttggtgtatttctgatttgtagaagtgtccaaacaggttgtgtgctggagttccttcaagacaaaaacaaacccagcttggtcaaggccattacctgtttcccatctgtagttattcgatgaagtcatgtacatgaccgttctgtagcaataaatgtgccatttttata

SEQ ID NO: 453729 - DNA, 824 bp, Homo sapiens
catgaggaagcggggcagccggcagctcccagactggagatgctctggggaaagcacttgcttcgatctattctccagatcacactaacaacagcttttcatcaaacccttcaactcctgttggctctcctccatctctctcagcaggcacagctgtttggtctagaaatggaggacaggcctcatcgtctcctaattatgaaggacccttacactctttgcaaagccgaattgaagatcgtttagaaagactggatgatgctattcatgttctccggaaccatgcagtgggcccatccacagctatgcctggtggtcatggggacatgcatggaatcattggaccttctcataatggagccatgggtggtctgggctcagggtatggaaccggccttctttcagccaacagacattcactcatggtggggacccatcgtgaagatggcgtggccctgagaggcagccattctcttctgccaaaccaggttccggttccacagcttcctgtccagtctgcgacttcccctgacctgaacccaccccaggacccttacagaggcatgccaccaggactacaggggcagagtgtctcctctggcagctctgagatcaaatccgatgacgagggtgatgagaacctgcaagacacgaaatcttcggaggacaagaaattagatgacgacaagaaggatatcaaatcaattactaggtcaagatctaggacctgacccagagcccatgggcggtgaaggcgcggagagggccacatgcgcggaagcgttgaggccggacccacggcgttcaagacccgcctgggcccc

SEQ ID NO: 453730 - DNA, 1897 bp, Homo sapiens
gtacacagcaacttcagaatggcagccacatggggcgccatggtagtcagggaggcatcgtcatggccatcagtcccagtgaggagaccaagctgcagatgttcatgtggagccgcatcatcttcagcctgggctttgtcattagtggccactacaaggactttgccagggatgtggcagcctccatagcattcaccaatgacctgaacggtgagcacccgcacaaggcagcggacatggagggtctgtacacgctggacacagcagaggtggatgaccgcagctactgggtcaggttccagtcctcatccctggcatcctggagtgggaccaggagcagagtgtcatctatggctccactgactttgtaagatggtggtgtggcccccatcgtgttgcctggatctgctggagcatgagttaactgctcaagaccctgtgccactgcatgctcaaccagtgcaacgatgaggcggagctcttctcggttgagggcaagggtgtcactggcaatgacagatactacctgctgagccccctccccctgacctcagcttcctgcctgtgccccacaaggagctgccagaggagtgctcccatgccagcttcccctgcacccacaggcacaggttctgtcgcttgtgccaggagctggtggatgtctttgtggagcacagttgaggagcagccctgtgaggctgaggctgcagccagctgcactctgctgcgggcacgggcaccctgggttgttctggggctggatcgttgaagagagaagctctggacagtgaagaagagctcgttttggccacaactcactagagcccctttcccatcccccacccacctgccatcaggctcccagatgcagaatctggagctttgtgttggttgcaagccagcaagcagtcaaaccagtgacccagctgagctgtgctgttctcctaaggagcatttggaagtcactgggtgggttgtgaaggtcacagtccctgagtgttggtgctgctggtttttagtgcttaggagttggccatgttaaatttcccacaccacaagtaactcttttccagaagccagtggcattcctgtctctgttggaagtcctggtctgaatgtggaccctctctccccgacctctatactctggctgtcttcttcctgtctggggagatctggcagccaccaccttgttgcctgggtctgtgagagcaaagctgagttctggtccggcttgtagcagaagaaggaatttgacaacatctataaggcccaggtgggctgtggcagggccggtgggttgagctgcgcctgtaggctgtgggcagctaatcctttcctgcctgtgctctctcccctgttttttggtgagaaccacgagaaggaaagctccgagatcctcaagtgcctggcccagcaggccatggcccagcagcacactgtgaatgggagatactggtcggctgcagtgccagcatcctgcccctccagctatatccctgggtggagctgggcccccacccggcctgggtaggatgagcctcactcacagctcatccccccacggcccctcagttcacagcccccagtatggccagcgtcttggagcagctccaggtcatcggtgatgtcctcttcattcttctcagctgaggcccctccatggctccctacttagaagttggcctttagttttttaagatatgtaataggctgacatggctcaaaattgaaaagtgtagccagtgatgagaacttccttgtgaatccttccagaaatactccatgtgatctttatccccctctttttttttctttggaattgtggcatgccacggatgaaggttattattgtttacttcatttaacaacgtatcttggtgatcttccaaaacag

SEQ ID NO: 453731 - DNA, 2061 bp, Homo sapiens
gaaacctgcaatgagcaaattcatgtatcaaaactctctttctgaattgtaatcatatacatgattaaatatcaggtgcgttaatgagtcaaagattgtaaatccagtctcttatgtataaacatatataatttagtgtatacattgtcatagatttttttatacataatatatgcatatatgtgaggttgtttttaaacttaccttacattttacattaaatttctccctaccctcaaatatgaacctatgacttctgtgaatctgtctcattcaaatgtcacttgattccagttatatattcaatttaacaatatcactataatcccaaaatgtccgtgaatgcacggacgcattcaccaatgacctgaacggtgagcacccgcacaaggcagcggacatggagggtctgtacacgctggacacagcagaggtggatgaccgcagctactgggtcaggttccagtcctcatccctggcatcctggagtgggaccaggagcagagtgtcatctatggctccactgactttgtaagatggtggtgtggcccccatcgtgttgcctggatctgctggagcatgagttaactgctcaagaccctgtgccactgcatgctcaaccagtgcaacgatgaggcggagctcttctcggttgagggcaagggtgtcactggcaatgacagatactacctgctgagccccctccccctgacctcagcttcctgcctgtgccccacaaggagctgccagaggagtgctcccatgccagcttcccctgcacccacaggcacaggttctgtcgcttgtgccaggagctggtggatgtctttgtggagcacagttgaggagcagccctgtgaggctgaggctgcagccagctgcactctgctgcgggcacgggcaccctgggttgttctggggctggatcgttgaagagagaagctctggacagtgaagaagagctcgttttggccacaactcactagagcccctttcccatcccccacccacctgccatcaggctcccagatgcagaatctggagctttgtgttggttgcaagccagcaagcagtcaaaccagtgacccagctgagctgtgctgttctcctaaggagcatttggaagtcactgggtgggttgtgaaggtcacagtccctgagtgttggtgctgctggtttttagtgcttaggagttggccatgttaaatttcccacaccacaagtaactcttttccagaagccagtggcattcctgtctctgttggaagtcctggtctgaatgtggaccctctctccccgacctctatactctggctgtcttcttcctgtctggggagatctggcagccaccaccttgttgcctgggtctgtgagagcaaagctgagttctggtccggcttgtagcagaagaaggaatttgacaacatctataaggcccaggtgggctgtggcagggccggtgggttgagctgcgcctgtaggctgtgggcagctaatcctttcctgcctgtgctctctcccctgttttttggtgagaaccacgagaaggaaagctccgagatcctcaagtgcctggcccagcaggccatggcccagcagcacactgtgaatgggagatactggtcggctgcagtgccagcatcctgcccctccagctatatccctgggtggagctgggcccccacccggcctgggtaggatgagcctcactcacagctcatccccccacggcccctcagttcacagcccccagtatggccagcgtcttggagcagctccaggtcatcggtgatgtcctcttcattcttctcagctgaggcccctccatggctccctacttagaagttggcctttagttttttaagatatgtaataggctgacatggctcaaaattgaaaagtgtagccagtgatgagaacttccttgtgaatccttccagaaatactccatgtgatctttatccccctctttttttttctttggaattgtggcatgccacggatgaaggttattattgtttacttcatttaacaacgtatcttggtgatcttccaaaacag

SEQ ID NO: 453732 - DNA, 478 bp, Homo sapiens
ctgaagttacctgccctggtttgcctggcacatagctggtggatcccaaacctgccgcagccctcatactccttggtagccactaaactctgtgcctctttaagcataagtgtttacttttttgtagaaatgattttcttgcccttctctaaatataaggaaactgaggcaagggtctctggctcccaaggcaggcctggttgcctctcccatcttggcgagctggaccaggtggatgtagcctgaggcttttgtgggcatggcctctcaccctcccagccttggtccctcccaggtacacagcaacttcagaatggcagccacatggggcgccatggtagtcagggaggcatcgtcatggccatcagtcccagtgaggagaccaagctgcagatgttcatgtggagccgcatcatcttcagcctgggctttgtcattagtggccactacaaggactttgccagggatgtggcagcct

SEQ ID NO: 453733 - DNA, 398 bp, Homo sapiens
ttgtggagcacagttgaggagcagccctgtgaggctgaggctgcagccagctgcactctgctgcgggcacgggcaccctgggttgttctggggctggatcgttgaagagagaagctctggacagtgaagaagagctcgttttggccacaactcactagagcccctttcccatcccccacccacctgccatcaggctcccagatgcagaatctggagctttgtgttggttgcaagccagcaagcagtcaaaccagtgacccagctgagctgtgctgttctcctaaggagcatttggaagtcactgggtgggttgtgaaggtcacagtccctgagtgttggtgctgctggtttttagtgcttaggagttggccatgttaaatttcccacaccacaagtaa

SEQ ID NO: 453734 - DNA, 4967 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttatttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagacgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaataaa

SEQ ID NO: 453735 - DNA, 4281 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcaggtcactacctctttttcaacactagatggcatcttggccccagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453736 - DNA, 4695 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagaggtaaacctggccaagtgtcaaagcccagaagagcccccggggagaaggttgctagctaagttgggaggaggtggcagtaggtaggagagggtttccagaatggctgttgtggcagttgtcacactgtgctcagttccccatgtggtcgtaggtctgatgcaacctttttcttgtctgtcctttagctgacccttttcagccttgccatgtcatgctgagttcatgctcttcaaccttgttgcttttccctttcagtcttccctttctttgttcctcattcctgcacagcccctcttctttcccaaagtgtgctcctctgaaaccctgatctggagcaatagttagtgacttgcctgcccagggaagaatgggcagccatgccatcttttttgtcttctcatcatgactctctgctcctctccatcccccatccccacaccccttgcattcttcccagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453737 - DNA, 4141 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453738 - DNA, 2060 bp, Homo sapiens
ctctctctgtccctggactgagctgttagcaaggctgattcctgatgtacctcccataggaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453739 - DNA, 3100 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaaggtaggtggtattctcaggacactca

SEQ ID NO: 453740 - DNA, 552 bp, Homo sapiens
gtattcgccttccatgaagagccttggcaataagttcatgcacctgaccaactacagtgtcaataaaaagaatgccgagtaccaggccaatgcagatgaaatggcttgccagggccacaaatggtactgagggcagagtgtcccagtccagtgaaggcctagaggaatacagggttctggggttttgggaggttcaggggcatggcgagtggaggattaatataagacccagagataacacttaccaattcagaattggtctatttgaggccggatgtggtggctcacgcctgtaatcctagcactttgggaggccaaggtgggtggatcacctgagttcaggagtacaggaccagcctggccaacatggcgaagccctgcgtctactaaaaatacaaaaattagctgggtgtggtggcaggcgcctacaatcccagctgctcaggaagttgaggcaggagaatcacttgaacctgggggacggaggttgcagtgagctgagatcgcgccacttcactccagcctgtgtgaaagagtgaaactccatctcaa

SEQ ID NO: 453741 - DNA, 484 bp, Homo sapiens
cattactctgttttgtctgtgttttaatcatcttttggtgagtgctctgcagttggatacttgaggaccattagggtggtgatagtaagatggaacaaaagcttggagtgctgctaaagaagttggaatggtagaatgagtcttgtcatcttcctcatggcctcacctctgccctcttcctgcactcacccttttcccttttgtagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccagtgagtgaatcacagtgggcaggagactatggtctgtgagtgggaacaacagagtattggacctggagcaaatctcatctcctttc

SEQ ID NO: 453742 - DNA, 524 bp, Homo sapiens
ggactttcccagccaatgtcttgtcacgggaaattttggagctgtattgcagaatgaagtgttggaaaaccttgtctttaggtgacatttaatggtgtggttgtatgtaggttagcctagtaccttatggattaatatgtacaaaataattattaattattgagcacctggctttttagaatcacaagttaaaagacagcacttggaaataaatcgtacgtcgtagtaacgacgcttcagggctgttgctttttccctttctctactccatgtttgtttttcgtcttagaagctgtatggaaattctgaccaaacccctttccaatcatgagaaagttgtccgaccagccctcatctacagtctctttcccaacgttccccctaccatctattttggcactcgggatgagagaggtaaacctggccaagtgtcaaagcccagaagagcccccggggagaaggttgctagctaagttgggaggaggtggcagtaggtaggagagggtttccagaatggctgttgt

SEQ ID NO: 453743 - DNA, 4238 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453744 - DNA, 4189 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453745 - DNA, 3752 bp, Homo sapiens
ctgtcaggtcttattagtaggtacgaaacagttgctcctccacctcaccccagccccatggagcttgctttttccaggccaccgtagtcctcaccactgccactttgcttcgaggtatctgaatttgagacccttgtccttcctgcgctgaccctcctctgcagctgccgcccctccctgtgtccttccaagaagtgccacatgcactgatctcttgtgtccccagatggtcatcatgggccagtgctactacaacgagacctgagcaagccatgcctggcttgctcaggtctctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453746 - DNA, 4911 bp, Homo sapiens
gcggtgtgtggcaggcggcagcggcgctggcggccgagtgcgcttgtcacgcgtggcggtgcgtggttgctaggggcgcctgaggctgccgggtagcccagcaggccgagggaggaagtagcgtggagccggtgccgagccggggcgaagctggatcccctagatagactgtcttcaagctcactgatattttcctctgcttgatccattgtgctgttgagagcctctagtaaatttttcagactgacagacttcaaggatgcagctgctactaccggaggtgtgtggcaccttacctcagcaaggccatgagaccgtgtggccatgatgtgggcccctcatggcctcagcaggaacacagcactatagtattggcctccgccagaaaaacagcttcaagcagagtggtccctcaggcacagtacctgccacgccacctgagaaaccctcggagggcagagtctggcctcaggcccatcagcaagtgaagccaatctggaagctggaaaagaagcaagtggagacactgtcagcagggttgggcccaggcctcttgggcgtcccaccccagccagcatatttcttttgccccagcactttatgtagctctgggaccacggctgtcattgcaggccacagcagttcctgttacctacactctctcccggacttgttcaacagcaccctgctataccgccgctccagctataggcaaaaaccgtaccagcaactggagtctttctgcttgcgttcgagcccgtcagaaaaaagccctttttctctccctcaaaagagcctccctgtcagtctcactgccaacaaggccacttcttccatggtcttctccatggcccagcccatggcctcctcatccacagaaccatacctctgcttggcagcggctggggaaaacccttcagggaagagcctggcctctgccatctcagggaagatcccatctccactctcttcctcctataagcccatgctgaataataattccttcatgtggccaaatagcacgccagtgcctttattgcagaccacacagggcctgaagccagtatcgccacccaagatccagcctgtctcctggcatcattcagggggtactggagactgtgcaccgcagcctgttgaccataaggtgcccaaaagcattggcactgtcccagctgatgccagtgcccatatcgccttgtctaccgctagctcccacgacacatccaccaccagtgttgcctcttcctggtataaccggaataacttagccatgagggcagagccactttcctgtgctctggatgacagctctgattcccaggatccaactaaggagattcggttcactgaggccgtgaggaaattgaccgcaagaggctttgagaagatgccgaggcaaggctgccagcttgaacagtctagtttcctgaaccccagcttccagtggaatgtcctcaacaggagcaggcggtggaaacctcctgcggtaaatcagcagtttcctcaggaggatgctggatcggtcaggcgggtcctccctggtgcctcagataccttggggttggacaatacagtcttctgtaccaagcgtatcagcattcacctccttgcctcacatgccagtgggctcaatcacaaccctgcctgtgaatctgtaattgactcctcagcatttggagaaggcaaagctccaggtcccccttttcctcaaactcttggcatagccaacgtggccacccgcctctcttccatccagctgggccagtctgagaaggagagacctgaggaggccagggagctggactcatctgatagggatattagttcagctactgacctccagccagatcaggctgagactgaagatacagaagaagaactagtagatggtttggaagactgttgtagccgtgatgagaatgaagaggaggagggagactcagagtgctcctcattaagtgctgtctcccccagcgaatcggtggccatgatctctagaagctgtatggaaattctgaccaaacccctttccaatcatgagaaagttgtccgaccagccctcatctacagtctctttcccaacgttccccctaccatctattttggcactcgggatgagagagtggagaaacttccctgggagcagaggaagttgctccgatggaagatgagcacagtgacccccaacattgtcaagcagaccattggacggtcccacttcaaaatcagcaaaagaaacgatgactggctgggctgctggggtcaccacatgaagtctcctagtttccgatccattcgagagcatcagaagctaaaccatttcccaggctcattccagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttctaccttaagtgagccatgtgtggtttgtctgggggccctggtgtggttgctgagttgtagctcaagaggagaaaacatacagaacatatttggaccggaaatcctttgttctgaatttgagggggtcttctgaggtccttatttccttaggtctttcctcacccctctcccaccgctgtcctgaggagaaacccttgaacttcctcagtagacaggcggagaggccacaacatgccgaacccatttcctgtcatcctagtcttgggtcttcaccgcctccttccaaatacccaccctgccagcagccctaggtcttcctgttctgaccccccatcactgctcgttcagccttctagacgtctctctcgtggacatctgttctttagctgttggctttctctgaggtgtgagagggtctatgaactttgtgaatttcccatggccccagtgaaggagcccagataatcccagtagctgttacctgtctccatgtatcaaaggacacagtccagggggagggtggaaggagatgtggtttctctatagtgcaacaaacatggtttctcaatgttctgctgtgcagcaagcagggtctggcggcttggtaggtgggtttcaggagcagtcactattgtaggatgggcttccaatcaaacctcagactaaactcttgtactgaactgattctacctccctcctctagactcagtaaacagtgactattcaataaa

SEQ ID NO: 453747 - DNA, 2033 bp, Homo sapiens
ctctctctgtccctggactgagctgttagcaaggctgattcctgatgtacctcccataggaaacgatgactggctgggctgctggggtcaccacatgaagtctcctagtttccgatccattcgagagcatcagaagattgggaggaaggaccggctatggcggaacctgtcacgtatgcagagccgctttggcaagaaggagttcagtttcttcccccagtcctttatcctgccccaggacgccaagctcctgcgcaaagcgtgggagagcagcagccgccaaaagtggattgtgaagccaccagcatcagctcgaggcattggcatccaggttattcacaagtggagtcagctccccaagcgaaggcccctcctggtacagaggtatctacacaaaccctacctcatcagcggcagcaagtttgacctgcggatctatgtttatgtcacttcctacgatcctctgcggatttacctcttttcagatggactggtccgctttgccagttgcaagtattcgccttccatgaagagccttggcaataagttcatgcacctgaccaactacagtgtcaataaaaagaatgccgagtaccaggccaatgcagatgaaatggcttgccagggccacaaatgggcactgaaggctttgtggaactacctgagccagaagggagtcaatagcgacgccatctgggagaagataaaggatgttgttgtcaaaactatcatctcgtcagagccctatgtgaccagcctgctcaagatgtatgtgcgacggccctatagctgccatgaactctttggttttgacatcatgctagacgaaaacctcaagccctgggtcctggaagtcaacatttccccaagcctccactccagctctccactggatatcagcatcaaaggccagatgattcgtgaccttctgaatctggcaggttttgtcctgcccaatgcagaggatatcatttccagccccagcagctgcagcagctccaccaccagcctgcccacctcccctggggacaaatgtcgaatggctccagagcatgtcactgcacagaagatgaagaaagcctattatctgacccagaaaattcctgatcaggacttctatgcatctgtgctggatgtcctgacaccagatgatgttcggattctggttgagatggaagatgagttttctcgccgtggtcagtttgaacgaatttttccttctcatatctcctctcgctatctccgcttttttgagcagccacgatatttcaacattctcaccacccaatgggaacagaaataccatggcaacaagcttaaaggagtagatctgctccggagttggtgctacaaagggttccacatgggagttgtctctgattctgctccagtgtggtctctcccgacatcacttctgactatctcaaaggatgacgtgatactcaatgccttcagcaaatcagagactagcaagctgggaaaacaaagctcctgtgaggttagcctactactctctgaagacgggaccacgcccaaatccaagaagactcaagctggcctttccccttatccccagaaacccagttcctcaaaggacagtgaggacaccagcaaagagcccagcctttctacccagacgttacctgtgatcaagtgctctgggcagacttcaagactttctgcttcctccactttccagtcaatcagtgactccctcctggctgtgagcccataactggcctctctccaaaagcctctgcccaggagcatgggcatcagctacctcacgggaaccagcctgctgttcagaccagtctgaccccctacccctttcaccctgtccctcctcagagtattttttgaagtggttgcattatagagatgggtatttgtagggccggagggatggtagtgatggggagaaggtgaggaagggtcaccctctgtcacctgtctgcctggctggcacctcatatctcagcagagaagccagtggtggccacgcagccttataaagcaggttttggtttcta

SEQ ID NO: 453748 - DNA, 561 bp, Homo sapiens
taaatgaatgtttttctttgtaatcagaaaaaaaagcctcgaagaaacactttttcttatgtatacaacagaactgcatgcacttagtggagttttatgggcatattctgtgatgttgagtgtctagtctataaaagacagggggcttggggaacctttgaatgcccccattggttttggagaggtggtgagacttttgggctcaagtgatggctagctgtgatattaactgtctttattgatttacagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtgggtgagtaaaactacggggacattgcctagggaaaaggctgagttgaactagaaagtcagggtggtcaccaattttgggaggagggaagatagatttagatgagaaatgaactagatttagatagggaaatttagataggcaacaagctcctga

SEQ ID NO: 453749 - DNA, 2948 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453750 - DNA, 4599 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaacttcctgcctcctccttcccccttccatttcaagaatatgtttgtgtgtagggtgggggtgggggttggaaggggttgcttgttactccccaaacttccattaaccagggcacccttgggttggagaggtagttccaaactctccattgatctatactacattctgggctgaaggttttcttattctggactatgaagaaaggactttcaaggagatatagtgtgaacaggatcaggaaggtagagggattatatttacttaagagaacaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctatcaattcccatctcatacttcccagttaattggaattaatgaaatttggctgctcccagacctttttccatgtcttcctttttccttttaacaggatttaagttgagcattcttgagagagagagagagagagagattggaagagagatggggagagactgactcagatccctctcctgtctgcttctttttctggttctctcagttttttttcttgaagttataaagccaaacctggagaatttgtaagttgttaggtttccccaggtaacttggcactcatatgaaccccattttaataagtactcagcccatctcctctcctgggctcagatggctctctctcctccctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaaagggccttaaattgtttggtcttttcaatggctgacactgtctccaactctccccttcctccttcttcctcaagcttcctatgcaccctactttcccaggccaggatggttggcactgatcccaaacctctgggggcaggtggaaattggctgtggtgagccatttcttcatgtccattcagctctgaggccttcctggccctagctgagatcatcatctcctcctttgcttttaccccaggagtgaggttgggttagaggtggattctgattccgtagcagctaaattccattctccctgtcctgaccatcctgcctttacccataaagcacccgttcctactgaccaaatctctttactttgttggagaaaaaaagtattttgtttttaaatctattttctaatttaaatgcaatttaatatgtaaatctctgcacttttgtgtgagcctacaaatgtgtatgtgttgggggtttttcactctctggtatttcttaataaagaaatctttcttttggggggaagccaattaatgaaggagccttgaatggttttagaaatacagggctgtctgtttctttgtgaat

SEQ ID NO: 453751 - DNA, 4645 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccatttaagcctcggctgagtgagggaaagcccagcactgctgccctcattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaacttcctgcctcctccttcccccttccatttcaagaatatgtttgtgtgtagggtgggggtgggggttggaaggggttgcttgttactccccaaacttccattaaccagggcacccttgggttggagaggtagttccaaactctccattgatctatactacattctgggctgaaggttttcttattctggactatgaagaaaggactttcaaggagatatagtgtgaacaggatcaggaaggtagagggattatatttacttaagagaacaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctatcaattcccatctcatacttcccagttaattggaattaatgaaatttggctgctcccagacctttttccatgtcttcctttttccttttaacaggatttaagttgagcattcttgagagagagagagagagagagattggaagagagatggggagagactgactcagatccctctcctgtctgcttctttttctggttctctcagttttttttcttgaagttataaagccaaacctggagaatttgtaagttgttaggtttccccaggtaacttggcactcatatgaaccccattttaataagtactcagcccatctcctctcctgggctcagatggctctctctcctccctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaaagggccttaaattgtttggtcttttcaatggctgacactgtctccaactctccccttcctccttcttcctcaagcttcctatgcaccctactttcccaggccaggatggttggcactgatcccaaacctctgggggcaggtggaaattggctgtggtgagccatttcttcatgtccattcagctctgaggccttcctggccctagctgagatcatcatctcctcctttgcttttaccccaggagtgaggttgggttagaggtggattctgattccgtagcagctaaattccattctccctgtcctgaccatcctgcctttacccataaagcacccgttcctactgaccaaatctctttactttgttggagaaaaaaagtattttgtttttaaatctattttctaatttaaatgcaatttaatatgtaaatctctgcacttttgtgtgagcctacaaatgtgtatgtgttgggggtttttcactctctggtatttcttaataaagaaatctttcttttggggggaagccaattaatgaaggagccttgaatggttttagaaatacagggctgtctgtttctttgtgaat

SEQ ID NO: 453752 - DNA, 2952 bp, Homo sapiens
ggcgtgtgtgagtgtgtacgagcgtgtggctgcgtgtgcgtgtggatgtggcgcgcgtcccaacctgcctggggcggtggtccgcggcgtggcggagtcagggcgggcctcgagaggccgcgcccgcggctcggccccggactccggcctccggcctccggccccccgctggggagccggtcgctgcttcccgacggattttgatctttgttcttccaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453753 - DNA, 2756 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453754 - DNA, 2578 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453755 - DNA, 2309 bp, Homo sapiens
aaataaagcgtttattgattagtagaagcatgaacagtgtgcataatattttcaatacaatatcagggagggatgatgggaacccctcaaaaggcactagaggcgcagatcttcgggacaagagggaagagatgcgccagagaccagggctggggcagctgggggtccctgagtgccaggcgccaccacacgtcctgtgggtcaaggcccctcctctggggagcaggtctacggcacggaggatgcagggctgggaggggaccccaagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453756 - DNA, 1048 bp, Homo sapiens
ttcacatgtattattgtgtagttttactactcatgttttcaagcatccctccaacaaaacagcagagataaccatttgtggctaggaaatgggaatttacagaagagatggcatttgacttggatcttgaggagtgtgtgggagtttatcatgtagacacagtagaagtgtcacagaccaagggaaacaccggtgcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453757 - DNA, 2524 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtgggggttggaaggggttgcttgttactccccaaacttccattaaccagggcacccttgggttggagaggtagttccaaactctccattgatctatactacattctgggctgaaggttttcttattctggactatgaagaaaggactttcaaggagatatagtgtgaacaggatcaggaaggtagagggattatatttacttaagagaacaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctatcaattcccatctcatacttcccagttaattggaattaatgaaatttggctgctcccagacctttttccatgtcttcctttttccttttaacaggatttaagttgagcattcttgagagagagagagagagagagattggaagagagatggggagagactgactcagatccctctcctgtctgcttctttttctggttctctcagttttttttcttgaagttataaagccaaacctggagaatttgtaagttgttaggtttccccaggtaacttggcactcatatgaaccccattttaataagtactcagcccatctcctctcctgggctcagatggctctctctcctccctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaaagggccttaaattgtttggtcttttcaatggctgacactgtctccaactctccccttcctccttcttcctcaagcttcctatgcaccctactttcccaggccaggatggttggcactgatcccaaacctctgggggcaggtggaaattggctgtggtgagccatttcttcatgtccattcagctctgaggccttcctggccctagctgagatcatcatctcctcctttgcttttaccccaggagtgaggttgggttagaggtggattctgattccgtagcagctaaattccattctccctgtcctgaccatcctgcctttacccataaagcacccgttcctactgaccaaatctctttactttgttggagaaaaaaagtattttgtttttaaatctattttctaatttaaatgcaatttaatatgtaaatctctgcacttttgtgtgagcctacaaatgtgtatgtgttgggggtttttcactctctggtatttcttaataaagaaatctttcttttggggggaagccaattaatgaaggagccttgaatggttttagaaatacagggctgtctgtttctttgtgaat

SEQ ID NO: 453758 - DNA, 1420 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggattttcctgtactggattttcatgtgggacccaccttacatagtgggaggagacacctagtccactggagggcagcattgaggaaggaaggtctgtctaagacgcaacccaagaagaggaaagttgctagcatttattgagtttctactacatattgggcactgtgctaagtgatttacctttctctcatttaagacttgtaacagccccatgagattggtattatccccattttacggatgaggaaataggtgaagcaccagtatgtaagttcacataattagtatgagattaagctagagcaggtctgattccaaactgcttatttcttctctttgctgctgctgcaagagggtcaggtatatgtgtgtctaatacagtggtctgtacttccatccacatatatgtggctttgttgtaatcactgcctactgtgtgctaaaccctggccaagatgagaaatgggccataaagattcctgttgataggcctatatgtgaaattgcttatatcat

SEQ ID NO: 453759 - DNA, 424 bp, Homo sapiens
attcgcgggcaatgctggcacttggaggccaggagaatcttctgaccccactctccctcctcttcagtcctgaagaccccaagaacccagttaggatcccctggccagaggtctctgtgactgcctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453760 - DNA, 4670 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaacttcctgcctcctccttcccccttccatttcaagaatatgtttgtgtgtagggtgggggtgggggttggaaggggttgcttgttactccccaaacttccattaaccagggcacccttgggttggagaggtagttccaaactctccattgatctatactacattctgggctgaaggttttcttattctggactatgaagaaaggactttcaaggagatatagtgtgaacaggatcaggaaggtagagggattatatttacttaagagaacaagctctatattaggatattgttttgaagcagatggatgccgttaattgctaataagtcttagttattaacgcaggctcatcagggcccccccttggaaatatttgatcagtggtcttttacaagtgatggtatatatttctttctaggtggtgtataatcaagactccctatcaattcccatctcatacttcccagttaattggaattaatgaaatttggctgctcccagacctttttccatgtcttcctttttccttttaacaggatttaagttgagcattcttgagagagagagagagagagagattggaagagagatggggagagactgactcagatccctctcctgtctgcttctttttctggttctctcagttttttttcttgaagttataaagccaaacctggagaatttgtaagttgttaggtttccccaggtaacttggcactcatatgaaccccattttaataagtactcagcccatctcctctcctgggctcagatggctctctctcctccctcaccttacctcaagtgttctcctgaggacccttaggtcagacagagaagctttctctttctgatgggaagggtcaaagtggaaatctcttatctctagtgtgaaatgattttctgctttttcatactccctgccctctttcttttccttaataaatcttccatgtttaagatgttggcctgaagatctgtcccattcataccatgcaccagctgggactgtccctatctgatcagaggggagattaaagaatcaatgttcccaggggaaaagggccttaaattgtttggtcttttcaatggctgacactgtctccaactctccccttcctccttcttcctcaagcttcctatgcaccctactttcccaggccaggatggttggcactgatcccaaacctctgggggcaggtggaaattggctgtggtgagccatttcttcatgtccattcagctctgaggccttcctggccctagctgagatcatcatctcctcctttgcttttaccccaggagtgaggttgggttagaggtggattctgattccgtagcagctaaattccattctccctgtcctgaccatcctgcctttacccataaagcacccgttcctactgaccaaatctctttactttgttggagaaaaaaagtattttgtttttaaatctattttctaatttaaatgcaatttaatatgtaaatctctgcacttttgtgtgagcctacaaatgtgtatgtgttgggggtttttcactctctggtatttcttaataaagaaatctttcttttggggggaagccaattaatgaaggagccttgaatggttttagaaaaaaaatattatatattcaaaaaacgaaggcgggccgaaggcttattccctttagtggaggttaatttttactttggtacctggcccgcctttttccaa

SEQ ID NO: 453761 - DNA, 3467 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaaaaaaaaaaaaaaaaaaaaaaaaaaaaagaaagaacaaccaacaaaggggggcgggggcgcgccactaggagatgctcccctcgacggggggcgccgcgaagtattgccgcggcaccccagcgtgttcttggtgcgcaaaacagggggggcccactgaatagaggagagccgtcgagatatatacaacacaacgaccgaagccaccgcgcggcggcggaggtttgacacagacgggctcgtgacaggggaaacatcggggacctatccgggcaggcgccatcctgtggcggagcaagagagacaccccacacccacaagcgcggcgggggggcagcacaaccacgttgcgccggcacacacccgccgccaagaacaccaaagatttccaaaacggccccgaggaggcggaacaatacacaacagacgctttgacagaggtgggatacacagggggttggtaaacaccaagcgcaggccatatgtccgcggcgcgcagaagaaagaacgttgccgcacaca

SEQ ID NO: 453762 - DNA, 2480 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagacaaaggaacaccggagatcctcgagagtcacctgca

SEQ ID NO: 453763 - DNA, 2350 bp, Homo sapiens
tcctattagacacagcattgctacctaaggagtcatattctctccctcctgaccttccccgccttcccggggcatcctctgcgccacgcccaggacgagggaggttaccaaaattaatctcccgctgggatgtgaagtcattggcgggtttacggaaaacatgggaatcgtcctcatagtcatcttttaccatcgtgaaacacaattacagcatcaaacacgcacaagtccacagccatcccagctggagattaattttggtaacctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcacactctctgtctcatctctcctcctttctcattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacaaatgggaaaccaaggcacagagaggctctcctctcctctcctctcccccgatgtaccctcaaaaaaaaaaaaaatgctaaccagttcttccattaagcctcggctgagtgagggaaagcccagcactgctgccctctcgggtaactcaccctaaggcctcggcccacctctggctatggtaaccacactgggggcttcctccaagccccgctcttccagcacttccaccggcagagtcccagagccacttcaccctgggggtgggctgtggcccccagtcagctctgctcaggacctgctctatttcagggaagaagatttatgtattatatgtggctatatttcctagagcacctgtgttttcctctttctaagccagggtcctgtctggatgacttatgcggtgggggagtgtaaaccggaacttttcatctatttgaaggcgattaaactgtgtctaatgcaaa

SEQ ID NO: 453764 - DNA, 2379 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtggagcgcttcgaccatcactgcccctgggtggggaattgtgttggaaagaggaactaccgctacttctacctcttcatcctttctctctccctcctcacaatctatgtcttcgccttcaacatcgtctatgtggccctcaaatctttgaaaattggcttcttggagacattgaaagaaactcctggaactgttctagaagtcctcatttgcttctttacactctggtccgtcgtgggactgactggatttcatactttcctcgtggctctcaaccagacaaccaatgaagacatcaaaggatcatggacagggaagaatcgcgtccagaatccctacagccatggcaatattgtgaagaactgctgtgaagtgctgtgtggccccttgccccccagtgtgctggatcgaaggggtattttgccactggaggaaagtggaagtcgacctcccagtactcaagagaccagtagcagcctcttgccacagagcccagcccccacagaacacctgaactcaaatgagatgccggaggacagcagcactcccgaagagatgccacctccagagcccccagagccaccacaggaggcagctgaagctgagaagtagcctatctatggaagagacttttgtttgtgtttaattagggctatgagagatttcaggtgagaagttaaacctgagacagagagcaagtaagctgtcccttttaactgtttttctttggtctttagtcacccagttgcacactggcattttcttgctgcaagcttttttaaatttctgaactcaaggcagtggcagaagatgtcagtcacctctgataactggaaaaatgggtctcttgggccctggcactggttctccatggcctcagccacagggtccccttggaccccctctcttccctccagatcccagccctcctgcttggggtcactggtctcattctggggctaaaagtttttgagactggctcaaatcctcccaagctgctgcacgtgctgagtccagaggcagtcacagagacctctggccaggggatcctaactgggttcttggggtcttcaggactgaagaggagggagagtggggtcagaagattctcctggccaccaagtgccagcattgcccacaaatccttttaggaatgggacaggtaccttccacttgttgtatttattagtgtagcttctcctttgtctcccatccactctgacacctaagccccactcttttcccattagatatatgtaagtagttgtagtagagataataattgacatttctcgtagactacccagaaacttttttaatacctgtgccattctcaataagaatttatgagatgccagcggcatagcccttcactatccctcaacttctttctcctttcagtcttggtgccacacttcaatctctcccttcttttaatttcaattcctttcattttctggtagagacaaagggaaaca

SEQ ID NO: 453765 - DNA, 1058 bp, Homo sapiens
cgacctggtgacgtgaggagcgttccatttggccagtggtgggcggttgccacagctggtttagggccccgaccactggggccccttgtcaggaggagacagcctcccggcccggggaggacaagtcgctgccacctttggctgccgacgtgattccctgggacggtccgtttcctgccgtcagctgccggccgagttgggtctccgtggttcaggccggctcccccttcctggtctcccttctcccgctgggccggtttatcgggaggagattgtcttccagggctagcaattggacttttgatgatgtttgacccagcggcaggaatagcaggcaacgtgatttcaaagctgggctcagcctctgtttcttctctcgtgtaatcgcaaaacccattttggagcaggaattccaatcatgtctgtgatggtggtgagaaagaaggtgacacggaaatgggagaaactcccaggcaggaacaccttttgctgtgatggccgcgtcatgatggcccggcaaaagggcattttctacctgacccttttcctcatcctggggacatgtacactcttcttcgcctttgagtgccgctacctggctgttcagctgtctcctgccatccctgtatttgctgccatgctcttccttttctccatggctacactgttgaggaccagcttcagtgaccctggagtgattcctcgggcgctaccagatgaagcagctttcatagaaatggagatagaagctaccaatggtgcggtgccccagggccagcgaccaccgcctcgtatcaagaatttccagataaacaaccagattgtgaaactgaaatactgttacacatgcaagatcttccggcctccccgggcctcccattgcagcatctgtgacaactgtgtgggtgagtaaaactacggggacattgcctagggaaaaggctgagttgaactagaaagtcagggtggtcaccaattttgggaggagggaagatagatttagatgagaaatgaactagatttagatagggaaatttagataggcaacaagctcctga

SEQ ID NO: 453766 - DNA, 516 bp, Homo sapiens
gactctagaggaccgcgttatccgtccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaa

SEQ ID NO: 453767 - DNA, 479 bp, Homo sapiens
cagtgaaagtcagaaattattaaaatgaaatctttaatgtgctgaaagaaaataactgcttacctagactctgcccagtgtagatatctttcacaaataagacgatataaagatattttcagataggtgtataacattcgtctaagtcaagatcgacaaacactgcctgttaaaataagacagaagctggaaacggaagataaacctgagagagaaagcatgactctggaatccacctgccatcagagctctctccagaccagtgctccttcccttcctcaccttcctgaatgcctcggcctggcacctgaactccccatcgctgctgccaccttcccccacccacttctttctctttcatgtgtgctacttcatcaattttttaaaagaaattctagtaaaaaaagaaaaatacctcatgacgattttctttttaaaatcatttgcttactaactaaatcaaatgttctatcccattt

SEQ ID NO: 453768 - DNA, 6143 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaatgtgtatccagagacatttgaattattaactttattctttattagtgaatctctatgatggcacacataaaatcttacagttgacttctgctgtttgaattccccagtgtttttacattaatgtatcctatggccagtttagtctttcttcaactgttacagttctaggccctaatcggtcttattctttcacatatgatgcatgatagatgtaatccttttctgaaggtttgtcggattggcatagtctattcaaaaataaggcttatgtaactttcagcttgctatgtgacagaagtttaaatgtgtatttaagtacacagctttatgttcctcttaaagctgtaaagagaaaagaggacttttcctcatcaagagagcttgggagacaaagcatacatttaatttttttctttcaaaaaaggcaatgtgcactttcctctcctaaattttatatgccctagcagttgcgaatgttgtgtccaccttacaatttgattggaggctcccatacactgaaactctcaatagaattcttaaaaatgaacatcagctgggcgcagtggctcacgtctgtaatcccagcactttgggaggccaaggtgggcagatcacgagctcaggagttcgagaccagcctgaccaacatggtgaaaccccgtctctactaaaaatacaaaaattagctgggcgtggtggcgcatgcctgtaatcccagctactcaggagactgaggcaggagaattgcttaaacctgggaagcagaggttgcagtgagactagatcatgccactgcactccactgccactgcctgggcaacagagcaagactccatctcaaaaacaaacaaaaaaaatcacagactcattttaaaggagcagcaacctaaccaaatacaaacttcatttgattttaggtttagaaattctagttttattttggagaatcactcagtttttaatatcaattaaaatagtcctcaaaggaatgaagaggaagtctaaataaatgaataaaactcatttttcattttatggtagtatagaaagcattgatgtgtgtagagaaattaaaagacaagagtggtttactgtctatgcacaaatgagtgcctatatttaaggctgcctataccattacagtggcgtaattggtgatttcatagcatacagagaaacaatgaaatcaaagattaaatcattaggttatgatggtcatttgtaagattggaaagtagtcaaaaacccatgtgcaactttttttcagcactctaccattaggctccttaggcaagctgcttaacttccgtcagaagcaaaggtgtgggagaacaccattcacctcagtagtaacttataaaaaccgtttaaagaaggaaaatgggccccagcccctaggatccctgacttcctgatattctaaacatgagagttctgtgactttaactgagctctttaccagaagtaacgtgttgatgtatattatctttccaccatgctttgaccaaagtacattcacagtaactagagaaagcagatcatccatttctggataggtgaactacggcaaggtaagaacag

SEQ ID NO: 453769 - DNA, 4349 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataata

SEQ ID NO: 453770 - DNA, 4508 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacagatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaa

SEQ ID NO: 453771 - DNA, 3633 bp, Homo sapiens
tctttaggctcaaatacttgaaaagtcagtatgaatatggaaagatttgtttacataaacgtgtatatttttagatgaaaaatcagggggtagtggcatctccctgatcccttaacaatatttggatttttgcaaagaattagcagcatccatgctgttttctaactatagttattcctgctttttttcctcctttacttcctttcttagttatccattcagctcattcctttcactgctaattctcaacctagccactgttgccaggtctctgtatttatgattggttctttggtttccattttatcaactaaagtaatcatgctgaatggtcagacatgaaatggagacatttaatacgacttttcttgtttctgtgttttctgattttttttttctttcagtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaa

SEQ ID NO: 453772 - DNA, 2752 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggtaagcaaactactgaaaagtttattaaagattctttttaacctaaaagacacccaatacttacaaattagaatttattataacttgtacttgaaaacctttaattttccaacttttctcaaatttctcctcagccaacatggtgaaaccccatctctactaaaaatagaaaaattagccgggagtagtggcgcatgcctgtagtcccagctactcaggaggctgagttgggagaattgcttgaacccaggaggaagaggttgcagtgagccaagattgcaccactgtactgcagcctgggcaacagagggagaccctgtctcaaaaaaaaaaaaagaaagaaacctgtctcacttatattaacagaataaagggggaaaaagaacctctatatttgtagaaaaggccattgataaaagtcaatacctgttcatgaaaaaaatgttttctacaaaaacacaatcaagaacatatttaacagtgaaacactataaactttcccttgaaatcaggaatgagacaagtgtgtctgctgttcccacttttatttaatatcatcaaagtatagctagcgcaatgaggaaaaagaactatcataattggaaaggaaaaaataaaactataattattcactgatgacagttacacagaaaattcaaaatagtttacaaataattagatctaatgtcacagttctgaatacatggtcaacataatataaatcagtcatttttaaaaacagtca

SEQ ID NO: 453773 - DNA, 1628 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctggtaagtccagaaacttgtgtaccacttttagagtggcatattggttattgacttcctctaagataaaaccaaggctgctaggttgtacaactgcagaggccgtggttcacattatagtttatgtgagtggaggccctgggaaaaagtactcacgtatattttcctcctgagatcgagtatcaggtggccaaatattgagatgattttgtaaattataaacattttttacttcgtttaactagctgtgataagatgtagaactttgtaagtttccttcccccaaaaaaatgtggta

SEQ ID NO: 453774 - DNA, 4562 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaa

SEQ ID NO: 453775 - DNA, 5217 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttaaaggttgcattatttatacttgagatttttttcccctaactattctgttttttgtactttaaaactatgggggaaatatcactggtctgtcaagaaacagcagtaattattactgagttaaattgaaaagtccagtggaccaggcatttcttatataaataaaattggtggtactaaaaaaaaaaaaaaaaaaaaaaaaaaaaaaaaaaaaaaaaaaaaaaaaaaaaaaaaaaaaaaaaaaaaagagagagagaagagaggaggggggggggagaggaaggaggggggggagaaaaaacaaaacagaggcacccacgcaagggggacaaaggggggcccacaaaaagagagaaaggaaaaaacaacgagcaagagaaggagagaaaggaaaaagagaacaagagagaagaaggggacagaaaagagaagagacgaggagcgcacacacagacgaaacagagcagcacgaacagacacaggagcgcgacaaaaacacgggcgacacgaacaaacaaacggcaaaagaaaaaagaagacaaacaaagggaaaaaagaagaaaaactgatcaggagaggagaagaagggaggagcgacaacagagaacggggaggcatgagaaggtggagacgcgagaaagacacgcaagggaaggcacaagggagcccgcacacacagacaagagcccgcaggcgcacacgcaagactacacagcggggagaacagcaccaggaggcaaagaacaaaagatagcgagacacagaaagcacaaagagaacagagagaagcaagacaacaccgacgacgagcagcacgccgggccgcgggcaggca

SEQ ID NO: 453776 - DNA, 4479 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaaaagtgcaacttaaagcagtaccttcattcatgaagctactttttaatttgatgtaacttttcttattttgggaagggttgctgggtgggtgggaaatatgatgtatttgttacacatagttttctcattatttatgaaacttaaccatacagaatgatataactcctgtgcaatgaaggtgataacagtaaaagaaggcaggggaaacttacgttggatgacatttatgagggtcagtcccacatacctctttcaggagacaacttgcaccagtttgaccttttcttttctttgtttttattttaagccaaagtttcattgctaacttcttaagttgctgctgctttagagtcctgagcatatctctcgtaacaaggaatcccacacttcacaccaccggctgaatttcatggaagaggttctgataatttttttaactttttaaggaacagatgtggaatacactggcccatatttcaaccttaacagctgaagctatgccttattatgcatccacatgtatggtccctgtagcgtgacctttactagctctgaatcagaagacagagctatttcagaggctctgtgtgccctcactagatagtttttcttctgggttcaaccactttagccagaatttgatcaaattaaaagtctgtcatggggaaactatatttttgagcacatggaacaaattatacttcctcattcatattatgttgatacaaaagaccttggcagccatttctcccagcagttttaaaggatgaacattggatttcatgccatcccatagaaaacctgttttaaaattttagggatctttacttggtcatacatgaaaagtacactgcttagaaattatagactattatgatctgtccacagtgcccattgtcacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaataacccccagacccaaatgaaaatttcaaagtcaataccagcagattcatgaaagtaaatttagtcctataattttcagcttaattataaacaaaggaacaaataagtggaagggcagctattaccattcgcttagtcaaaacattcggttactgccctttaatacactcctatcatcagcacttccaccatgtattacaagtcttgacccatccctgtcgtaactccagtaaaagttactgttactagaaaatttttatcaattaactgacaaatagtttctttttaaagtagtttcttccatctttattctgactagcttccaaaatgtgttccctttttgaatcgaggtttttttgttttgttttgttttctgaaaaaatcatacaactttgtgcttctattgcttttttgtgttttgttaagcatgtcccttggcccaaatggaagaggaaatgtttaattaatgctttttagtttaaataaattgaatcatttataataatcagtgttaacaatttagtgacccttggtaggttattggctatttactggaattttccctacatcgtttggcttaaacactggggatactggggtgaaaggattatggtatgaaagccgccggttttta

SEQ ID NO: 453777 - DNA, 2823 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcaatccaaggctcgtgacactaaggtattgatagaagacacagatgatgaagctaacacttgaattttctgaagtctagcttaacatctttggttttcctactctacaatcctttcctcgaccaacgcaacctctagtacctttccagccgaaaacaggagaaaacacataacacattttccgagctcttccggatcggatcctatggactccaaacaagctcactgtgtttcttttcttttcttctggtttaattttaattttctattttcaaaacaaatatttacttcatttgccaatcagaggatgttttaagaaacaaaacatagtatcttatggattgtttacaatcacaaggacatagatacctatcaggatgaagaacaggcattgcaaggaccctctgatgggacggtactgagatatctcggcttccgctcagcccggttttgactggttgaaaccggacattggtttttaaattttttgtcagtttatgtggagaatttttttctttccttcatacccagcgcaaaggcactggccgcacttgcaggaacttttcttttttggggggttgctgggtggtgggtttt

SEQ ID NO: 453778 - DNA, 2307 bp, Homo sapiens
ggcggggaggggcggggctatggagaggaggaggaagatggcgggcgggctgctctgaagagacctcggcggcggcggaggaggagagaagcgcagcgccgcgccgcgccggggcccatgtggggaggagtcggagtcgctgttgccgccgccgcctgtagctgctggacccgagtgggagtgagggggaaacggcaggatgaagttcgccgagcacctctccgcgcacatcactcccgagtggaggaagcaatacatccagtatgaggctttcaaggatatgctgtattcagctcaggaccaggcaccttctgtggaagttacagatgaggacacagtaaagaggtattttgccaagtttgaagagaagtttttccaaacctgtgaaaaagaacttgccaaaatcaacacattttattcagagaagctcgcagaggctcagcgcaggtttgctacacttcagaatgagcttcagtcatcactggatgcacagaaagaaagcactggtgttactacgctgcgacaacgcagaaagccagtcttccacttgtcccatgaggaacgtgtccaacatagaaatattaaagaccttaaactggccttcagtgagttctacctcagtctaatcctgctgcagaactatcagaatctgaattttacagggtttcgaaaaatcctgaaaaagcatgacaagatcctggaaacatctcgtggagcagattggcgagtggctcacgtagaggtggccccattttatacatgcaagaaaatcaaccagcttatctctgaaactgaggctgtagtgaccaatgaacttgaagatggtgacagacaaaaggctatgaagcgtttacgtgtcccccctttgggagctgctcagcctgcaccagcatggactacttttagagttggcctattttgtggaatattcattgtactgaatattacccttgtgcttgccgctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctgtttcgagtatttacagcccccttccataaggtaggctttgctgatttctggctggcggatcagctgaacagcctgtcagtgatactgatggacctggaatatatgatctgcttctacagtttggagctcaaatgggatgaaagtaagggcctgttgccaaataattcagaagaatcaggaatttgccacaaatatacatatggtgtgcgggccattgttcagtgcattcctgcttggcttcgcttcatccagtgcctgcgccgatatcgagacacaaaaagggcctttcctcatttagttaatgctggcaaatactccacaactttcttcatggtgacgtttgcagccctttacagcactcacaaagaacgaggtcactcggacactatggtgttcttttacctgtggattgtcttttatatcatcagttcctgctataccctcatctgggatctcaagatggactggggtctcttcgataagaatgctggagagaacactttcctccgggaagagattgtatacccccaaaaagcctactactactgtgccataatagaggatgtgattctgcgctttgcttggactatccaaatctcgattacctctacaactttgttgcctcattctggggacatcattgctactgtctttgccccacttgaggttttccgacagaagctggaaacggaagataaacctgagagagaaagcatgactctggaatccacctgccatcagagctctctccagaccagtgctccttcccttcctcaccttcctgaatgcctcggcctggcacctgaactccccatcgctgctgccaccttcccccacccacttctttctctttcatgtgtgctacttcatcaattttttaaaagaaattctagtaaaaaaagaaaaatacctcatgacgattttctttttaaaatcatttgcttactaactaaatcaaatgttctatcccattt

SEQ ID NO: 453779 - DNA, 1505 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453780 - DNA, 1407 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453781 - DNA, 1462 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggcccgcctcccggccatcattacaactccctggtgggttattgtttccgacgaaataa

SEQ ID NO: 453782 - DNA, 1375 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453783 - DNA, 1394 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453784 - DNA, 1457 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacgacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453785 - DNA, 948 bp, Homo sapiens
ccctagggtgcatagtcaggaaaccttggggcccagttcttaggttcaaagttcagtcagcaatttgctagatgtattagcctcaggtggtacttaacctcagcatcaccgtgtataaaatgggggctcctctaaacagtgctcaggttttatggttgtgagaattaaatgagatggtggatataaaggatttagcaccatgcttgcatgggatgctctcaatatctcgagcaccacaaatacgaggtaccattcatagcatccttctatttgtcccctcctccctgctcccctgctgtaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453786 - DNA, 886 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453787 - DNA, 943 bp, Homo sapiens
  misc_feature (829)..(829): n is a, c, g, or t
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgacccccgcctcctttctgttttatttttgaggaaataaaataaccaagtgctaaaaaaaaaaaaaaaaaaaaaaaaaaaaaaaaaaaaaanaaaaacacaagaaaaaaccataaaaaaaactcgcgggggggcccgtgccccaatctgccctatggtgggccgtattccacttcactgcccgaaattttacaacgtctcgactgg

SEQ ID NO: 453788 - DNA, 1608 bp, Homo sapiens
  misc_feature (1494)..(1494): n is a, c, g, or t
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaaaaaaaaaaaaaaaaaaaaaaaaaaaaaaanaaaaacacaagaaaaaaccataaaaaaaactcgcgggggggcccgtgccccaatctgccctatggtgggccgtattccacttcactgcccgaaattttacaacgtctcgactgg

SEQ ID NO: 453789 - DNA, 1681 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggtcgccaatataaatgcttgatgagtgaatgaatgacttccgtctgggacttggttgcaaataaagccgagctgcatcttagggaggggtggagactttgcccctgtttgtgccttgaagccagcagggccttgccctaggatacctccacccaccctcctgcccagcaagtggaggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453790 - DNA, 1070 bp, Homo sapiens
aataaaacagaaaggaggcggggcccagctcagcaccaggtgggcagctcggagttgtggcctccctcctccagggctcgcctccgcctttcctcccgcccctactggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453791 - DNA, 1602 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacgctggagtacagtggcgcaatctcggctcaccacaacctccgcctcccgggttcaagtgattctcctgccttagcctcccgagtagctgggattacaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453792 - DNA, 1322 bp, Homo sapiens
tatagaatgggaggtgatacacgcctagcaggcttgttgtcaaaacaaactaagctcactgcagctggatcagtgatgaatgtcactgtcgtcatcattcccactccacagcctgaggcctggccaagtgctcctgtgatgtgccacaccagtccagcaggcaggggaaacatgctttgcttggtgggattcaaggtgtagggatggccctccctttacagtcaccaccctgggttgagagtttgttcctcctccttgctctgggctggtctctatgtgatatctgaccaagcccggtaactgtgtctgttaggtgggatgcatgacccattccagcctctccacagactcgggagtgctgtctctatgccagggtctgagaatagataccgatacatgggtcagcagctcctgtgggggtgtcactccactgcggagggaaaccaaggcagaagctggacaagagtctgaatggctcagatttgaatcattcgtttttggggggttttttgtttgtgtttgtttctgttgttgttgttgttattgttttgagacggagttttgctcttgtttcccagctggagtacagtggcgcaatctcggctcaccacaacctccgcctcccgggttcaagtgattctcctgccttagcctcccgagtagctgggattacaggcattgaacctggccacatcccaggtaccgtgaacatccccttcacagacttcctgagccaggaggggctggagaagagccctgaggagatccgccatctgttccaggagaagaaagtggacctgtctaagccactggtggccacgtgtggctctggcgtcacagcctgccacgtggcactaggggcctacctctgcggcaagccagacgtgcccatctacgatggctcctgggtggagtggtacatgcgcgcccggcccgaggatgtcatctcagagggccgggggaagacccactgaagctgggcaggacacaggcgagctcaggtgatgccggccaccagcaatgcctggcctggtagctccgcttctgctttcaccaagagagtgtttcttcactcaactcaggtggcatttggggtgacatctcaaaggccaggaattccgttgacttgttggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453793 - DNA, 1082 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggcaagagccaacctgctcccgccgagttccgcgctcagctcgaccccgccttcatcaagacctacgaggacatcaaggagaacctggaatcccggcgcttccaggtggtggactcccgagccactggcaggttccgcggcaccgagcccgagccccgagacgacggtaacgcgggggaagggggcaggaggtcgtcgggggcgcggcctctacgccctgagcagtgccctggacttgacctttcttttatttttttaatttatcttgctttcatttcctttccttttttctttcctttccttccctttcccttccctcctttcccccttttccctacccttgccttcttgcactccagcctgggcaacaagagcaaaactccatct

SEQ ID NO: 453794 - DNA, 886 bp, Homo sapiens
ggcgcgggggccgcgcgggcctgggctgggcggagcgggcgtacccccacggcccggccagtggaaggcgcgggcagcagcggctccgagtggccgcggcggtgggctgtgccggagtctcctccctttggtccgctgcaggttggtggcgggaggaggggacagctgcgggcgcggggagggggcgccgcgccgcgggggccatggcggagccaggaagccgggagtccgagacccgggcccgcagcccgagtgtcgccgccatggcttcgccgcagctctgccgcgcgctggtgtcggcgcaatgggtggcggaggcgctgcgggccccgcgcgctgggcagcctctgcagctgctggacgcctcctggtacctgccgaagctggggcgcgacgcgcgacgcgagttcgaggagcgccacatcccgggcgccgctttcttcgacatcgaccagtgcagcgaccgcacctcgccctacgaccacatgctgcccggggccgagcatttcgcggagtacgcaggccgcctgggcgtgggcgcggccacccacgtcgtgatctacgacgccagcgaccagggcctctactccgccccgcgcgtctggtggatgttccgcgccttcggccaccacgccgtgtcactgcttgatggcggcctccgccactggctgcgccagaacctcccgctcagctccggctgccagtaggggcgggaggaaaggcggaggcgagccctggaggagggaggccacaactccgagctgcccacctggtgctgagctggggccccgcctcctttctgttttatttttgaggaaataaaataaccaagtgctaaaaaaaaagaaaatacaaaaaacccagggacataacgcgggtgcgaaag

SEQ ID NO: 453795 - DNA, 4453 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccaacactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcgtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacaggcccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcctccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 453796 - DNA, 886 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagc

SEQ ID NO: 453797 - DNA, 284 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttgggctggagtgcagtggcatgatcacggttcactacaacctccacctcctgggctcaagagatcctccccctcatcttccctggtacctgagactacagg

SEQ ID NO: 453798 - DNA, 4387 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggactacatggaccccagccaggactccagcatgccttacgcgccctacgtggagcccaacactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcgtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacaggcccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcctccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 453799 - DNA, 1825 bp, Homo sapiens
ggtttgaggctgggaagcagccctgcctaggagtcaggagacctgcttccgatcggggctgcctctgattttcctagcctctgtcttcccatccataaaatgagagggtaggatctgggggacacaggtgtcgacatcagatgcacatgggccaggcagggcctgagagccgtgagcaggccgggtgacacatgcgtgcctatcctaagtcctaagagggtacctctgctcggctgccaagcaggaatagggacctagagaaggcagaagtctgaatttttacatgaaatctgatcttgatatgttggaagtttattcaggtttaaacaatatattgtgtgtgtcaaacaaagtatgtctctgggcccagcaggccctgggctggcagctcggctggcccctctttcccactggtctgggtcatgtctgtttcttctctcctaatcacccttctgcagagatctggggccacatcacctccatagccccatcccaagagccctccccataacccacagctgcctcccctctggaccggcgagcacttctgggcccagcctcctgcaaggagactcttgaggctacatacaggccgccagccgtccctgtttcccccatccttctggtttgccccgggttgacgtctttttctttttgagggcccctggatatccatttttgaggggtacacccatctccccaacaatattagaagatagcatttggagggggagacccgtggttcaggccctagtgggccagccttggctgctccacccctcagtgtcctcaagactgggtaggaagaaccaggtgaccccaggggatctcagtccagagaaggtgccccagaagtggggaccacccagcctacagggaggagtttaggggcggggctcacagaggagtagtggatgatttctagccatgggtctgaagtacctgaccaacaggtgcctgcccggccccctgaagccagcctccctcctggcacctctgcagctcttccccactggcctcacccctactctctcctggcagagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattca

SEQ ID NO: 453800 - DNA, 2032 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattcattcattcattcattcattcttctctccagagagtcaggggcacctccagaatctctactttaagagtaattctcatgtgatgaatccttgttcctccaaaggattttggtctctggttctacacaggtttcctgcttgaggcccccagctgcctgggcaggaactcacccattcctccactctctgctggagttgaggaggctggtggagcacagacagttcccccaaagcaatgcctcaaccctgcgagggcctgagcacatcgagagtgagcttcctggcactggaggcatcccagtgcagatgcagactgcctgctgcacgctggagatgctgcagagagagcacctacactgagacagtggggccagggtgaccaccaggtccctgggctctcagtagaactcccatcctccctctgcagcccaggccagcgggggcccaggcctctcctttgctcctgtcttgtggccccttaaactggttgcccaaatgaagctttgacttagtgagggcagagagctgaacacagagacagtatgagtgcctacagccagaggcatctccctagaaggatcagtaggggtcatctgctccagccctctgcctctgtacaggaaaccagcctggatagtagagccagggagctcggggagaaccgcgtctacagacattgct

SEQ ID NO: 453801 - DNA, 1187 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagcaaaaaaaaaaaaaaaaaaaaaaaaaaaaacccgggggccttaatgggggggggggaaacaaggggtcactgaaagtgccgccagtggcgccaaacagcgtgttcccgtgaccccagtttcttgggcaccacaggggggaaacaatctgcgcagggggtccaccacaataagggcgagcgcgcgaatataaacttccgagaaaacgccgggtaaccccgggattaagagcgcgcagaacgaaaaaggacacaccgagcgagagaacagcaccacgctaccagcaagcgcagaaagaagagag

SEQ ID NO: 453802 - DNA, 826 bp, Homo sapiens
cagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagc

SEQ ID NO: 453803 - DNA, 1354 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctggagcctgaccgcagccctggccgtgcggagattcaaggacctaagcttccaggaggagtacagcacactgttccctgcctcggcacagccgtaggcctccccggcttgcagaggccggcagccctgtatcacccctggcagtgaggtggcaggagcagcctagtgccagaaatgtccaagatgccagggcatgcagggcagtggaaggctggcttgaggaaccaattcaggttctccactgactcattcattccttcaccgcctccttcattgattcttcatgcgttcattcattcagtaaacatttattgagcagctgttttgtgcctagtgatgaattaggtggggtccttggctccaggagcccacaggctggggaggagaaaacaaacacatcaatatctcttccaaatggacagccgtggacagttaccaggtaggtagcggccccatacatgggctgcctagaggcgttcatggtccccattgctgagctgtgggtgcagagcaatagcctctcccttcacagcggtgtgaagagtgacctcactgtccttagggttagcatcctggccgaggatgtcacagggctcctggtctggctctgtcctcatgtgctatgtgaccctgacaaacccgtgcacctctctcagcctcagtccacttacctgaactgaggggtgataatggaccaacctctcaaggctgttgtgccaatgaaacaaaggccagcccagggcttagcacaagcatgctcaataaatgtaagctcttttgttcattca

SEQ ID NO: 453804 - DNA, 4393 bp, Homo sapiens
cagcaggcatgcctccttggtctcatgttgaccttagagtttgggattctggaattcgatccttcatggataggcagctggacacagaggtcgtgggtgagctggaggagcaggcccggatgtgagctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccaacactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcgtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacaggcccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcctccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaaccca

SEQ ID NO: 453805 - DNA, 4671 bp, Homo sapiens
cgcgcaggggagggggcgggggcgccgcgcacgcgcacgggccggcggcgcgcgccgagcggggggcaccgcgcgggtgcagccacgatggaagggggtgcgtacggagcgggcaaagccgggggcgccttcgacccctacaccctggtccggcagccgcacaccatcctgcgcgtcgtgtcttggctgttctccatagtggtgttcggctccatcgtgaacgagggctacctcaacagcgcctccgagggggaggagttctgcatctacaaccgcaaccccaacgcctgcagctatggcgtggccgtgggcgtgctcgccttcctcacctgcctgctgtacctggccctggacgtgtacttcccgcagatcagcagcgtcaaggaccgcaagaaagccgtcctgtccgacatcggtgtctcggccttctgggctttcctctggttcgtgggattctgctacctggccaaccagtggcaggtctccaagcccaaggacaacccactgaacgaagggacggacgcagcccgggccgccatcgccttctcctttttctccatcttcacctgggcgggccaggctgtgctggccttccagcggtaccagattggcgccgactcggccctcttctcccaggactacatggaccccagccaggactccagcatgccttacgcgccctacgtggagcccaacactgggccggatcccgccggtatgggcggcacctaccagcagccggccaacaccttcgacaccgagccccagggctaccagtcgcagggctactgagccacagtgaccgcctgcccccgcccctccccatctgtcccctctctccacacccagcccctgctcctgcccaggctgccctgcccagcgcctcatcagcctctgccttgtcccactgaggtccagggtagctcggggcaggggtggggcagtccagtgttggggactgtctacgtatgtgcaagtatatcccagggcatgtgccccgcaggggcctagagggtgggggccaggggtatttgcattcgtacattgtgtcatcaagcattccttgagcgcctactgggcatccggcctgtgctgggcatgggtggtgacattggcagaaatggccactggaaaggggagcgatgagctgtggaggaagccctggtggtaccagaggccagaatggtgggaaagacagatccagataatgctgggaagtgtggctacaccgtggcttggtcatagggtgagtgtaaacacccacaggacactgggggctgtcaccctgctctggcagtcctgctaagagtgtcagggccgtctccattttatggttgaggaaactgaggtctagagaggtcaagattacttgcccagaatcactcaggcagctagtgatagaggtggggccaagcccaggctgcccgactgcagaccacgtgctcttccctggccacccacctcctaccatccccacgcttggggcttccctgctcagtgttactgtcattctgggaggccttggggccctcagccccttgagacaccctgattctgctgcatgccaagggcctgttctgccccagctgttcctcctcccctggggacaggcccacctccgggtccctccacccacatccccctggtcctacccctggcccttggcctcctccaagagggctcaccccgggtgctgctctgtgctctgcgtgtcccacagacgcttgttccagggggctccagcaaaccccttcgtggtctctcaaaggactgatcactgtccttgcctctaggaggggtcactaagcccttacctagggctgggtggacaacaaggcacagatgagggtgtgactggcccgaggtcacggtgagtgagtggcaaagctggccctgacgcctgggtttcttggccccagctgcccagcaggtgcctcgattccctgcccttgtgacctcccaggaaacagaactgatctgggacactatgtcacctctcctctcatctggggtcagtcagggttcgggggctgcagcagccaagcgcatgagaggtgtttccttggccttccagaaggcccactgtggagccagcctccctatgggaggcagagcggcaaggacagggctttggaatcagccaggtcggctcctgggctgtggccgtggagagacactgcccccaggatgacacaggcaagagcccctgaggcatgggaggcccagggaagaccatgggctgtaggggagagtgtggcaggtgacccaaaggcccaaagagggccgtggggcctgaggaggtcataatctcttctgagtgggggcaggtcgattcttgcacaaggtgggctcttcactgagccataagggacagggaggtatgggagagcgctgggggcccatccccctgtccacccagtgtccactggcctgtccttcagggagcagagcagagcaggtggtggacgggcccagtgctgggtgttttcaccaccatccccccatcccccatctaagaatcctaagaggcaggcgatccctcacctgcttactcactcagcagttacccggcccctgtgctggagataccaagggcatgggtggtccctgcttcgatggccccaaagctgggccagagttaagggaaagaggaggaagtcctaagcagagaagtagcaccattatccccatttaacagaagggaaactgaggctcggcaagcataggcgagttggcagtggaacacggatctaaactcaggtgtgtccaagtcctcccaaaggacagcagtgatggagaggaccccagccagctgtgtgacagctggttgttgctgacttcattttccaatccggagaaggggctctgtccacagtcccccgccgccaggtggcccacatgggaccagcatgggggcaggttatctgttggcctgaagagtgaaacctgtaccaggccaaaggtgagggcgtgagtgagggcaggagtgtttatggcagagtgaagttctgtgcccaccacaagaggctgtgagatgttctgaccctcacccactgtccaccaaaagcctctcctgctgatgggcactaggagacctcagggtactgcccatctgtttctcctcgggtgccagccagctgctggtgatcctcagccggagggcagggtaccaggtaagcttaactccatcttgggtgtttgtgacaggccctgcctgccaccctaggcagggaaagctgtcaagactcctgccaggaatggggggtgctgagtcatctcacgaagaatccctcactcttcccgggttcagcccagaagcccttccaggcatgatcttccccatcaggctgggctctggcagggacctgcccaggatggagatgagagagggtgagagatggagggcgagatttggatgggacccagggctcctgactctgccctggaaggttcatggggaaactcgctccttctgttggcagaggacagcccctggggaaccccaggcccaactctgtccggtatcccttttcctcccagctgccctcccctacttctcccttgctcccaaagctttccttggagaagggccctcctgcagctggaccctgcagggtggctccctcctccccatcaagcacaagagagggcccaggaaaaaaggtttcacataagtgtagagtcgcaaggacgcttagagtcggcagagtctggggtagggagacagcgacttgtccaaggtcaagcacagagggagaggttcaggagtcaggtcttctgccttctgagttggctcatcctgggcagtcacagactgtcctgcctgcacggctcctatccacctgggggtgtcgcagttgaggggctaattcccaggggactgacgttagttccctactccatccttccctggtgattcttgatcttcaaagcctcggggatcccaggtttccccatgtaactgagacaccctgcctgttagccctgggagacccctaaccttggcccaagacccctttgattctctaaggagcacgaaagggggaatgcccctcccaggagtttatgggagaagggactgggccggctgcctcccagcgatgcacttgacctgacactccccatgtcctggtgcgcacagcccttgtcggtgccccggcccctcccgcagcgttactgcctgtgtatagtataaatatatatattttctatatataagatgtataatataaggctccacaaatatatctgtgtgtgtgtgtgcgtgtgtgtgcggtgaagggcggtccccatcctgggcctccactctagacccccccaccacctggttaagtctcgagtgaatccagtggccccgtggcaccctcctttatgacatccatccatctgtggtgaaccaagtgaaggtggtgacttctggtgacatagtaataaagtgaagactcagaacccaaaaaaaaagtcaacgacacaagaggatgggggagacaacggtggaaaacagaggggggggggccaccagacgagagcaccccgggaggggccctcaaggacagacgcagcccaccaggtgtagtcaaaagcggggcgccccacaagagaggcgcaggatgaagacaacggcgggcgggcgcgcgactctaacacaaggacggcacgggcggagaaccg

SEQ ID NO: 453806 - DNA, 853 bp, Homo sapiens
aatgaatggttctcaaacttccacagagcctcagggttccctggcagtgcctctgggaggtgggctgggccccaggtgggcaccccacctgcttggcagatgcacgccttgtcctgagcaggtctgggcttctctggggagaccttggcactcacaggagattgcgtggctatgaggctcccactgctgacgcccccaggctcggctctcagtgggcccctcgctaaacctggggctctgtggggtcgcagcacgttagaagtcgaagcccagacccacccagccaagctgccatccttgccccagcctcgtcctccttcccatacctcatttgtctggcagcctgagggttggggtcttcctgcctgcagagttgcaggcatcaggggtggaccgggggggcccacgtcagcggtgtggctggacatgggggtttggcagaggctgcagaaatgcggcctgagttgattaccttctttctctgtctctccctccatcctcccctctcactgcccgtggctctcctctgactggccctgaccctgccctgtctgtggcctcctcccccctgcatctggctggcttccctcttctcgcctgcatcttctcttggctcccctctctcttcccctaccccctttgcctgtccctttgggggtgggggagcatgggagatgcactcttgaatgtccctctgttcctcggcttccccattttctccccactcaccctctcccccatgtgtggcactgcctattctgcccggtcctgggaccccccagccttctgggctttcctctggttcgtgggattctgctacctggccaaccagtggcaggtctccaagcccaag

SEQ ID NO: 453807 - DNA, 7287 bp, Homo sapiens
  misc_feature (3181)..(3181): n is a, c, g, or t
agacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtaagggcgccgttggaggactgaaggccagcgccgaggctggagttactgccactgcctccgcgcttgggaagggaaatcgggtcctcggccagtcgcactccgagaagccgaacttttcagccaatcccttctacccgtcgccctcggggacttgggtcggtccgctgggctccgctagggcttaattcaatggactgtttacacccgggcgaacacaaggcggggcgcggggaggagcgtcacagagggggccaagcaaagaaaaatatttccgccggccaaatcgcgtctctaagcggttttcagaaggcgtgaagcttgctggctcttctttttcctatcgctacatgacaagctaacagagagagcggagagtttgtgcttttctttccggttccccctctgagctgctgcccagtggttcggtctttcccgctttcccctcccctcccccgttcaatcagcggcggtggcttccgtcttaaaggggccgcggcggccgggggaggaggaggtgggacgccccgcggcctacgctcctggcctccccgccttggcctggccgtttaaccgattctttcgcccgcaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgngagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccgtctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgatgtaccaaggcagcaggggcttttacctgctaagcggcaatcctttggccctgagaatttgggagagaacagtgcatcaggccaggctcagcaatatgtttgctcacattctttcagccttctctcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgtaacatccctagtgaggctccagcctaatgagccccttattttctttttcttccctccccaggtctcgtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattgggtcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaaaagtg

SEQ ID NO: 453808 - DNA, 7156 bp, Homo sapiens
  misc_feature (3181)..(3181): n is a, c, g, or t
agacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtaagggcgccgttggaggactgaaggccagcgccgaggctggagttactgccactgcctccgcgcttgggaagggaaatcgggtcctcggccagtcgcactccgagaagccgaacttttcagccaatcccttctacccgtcgccctcggggacttgggtcggtccgctgggctccgctagggcttaattcaatggactgtttacacccgggcgaacacaaggcggggcgcggggaggagcgtcacagagggggccaagcaaagaaaaatatttccgccggccaaatcgcgtctctaagcggttttcagaaggcgtgaagcttgctggctcttctttttcctatcgctacatgacaagctaacagagagagcggagagtttgtgcttttctttccggttccccctctgagctgctgcccagtggttcggtctttcccgctttcccctcccctcccccgttcaatcagcggcggtggcttccgtcttaaaggggccgcggcggccgggggaggaggaggtgggacgccccgcggcctacgctcctggcctccccgccttggcctggccgtttaaccgattctttcgcccgcaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgngagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccgtctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgatgtaccaaggcagcaggggcttttacctgctaagcggcaatcctttggccctgagaatttgggagagaacagtgcatcaggccaggctcagcaatatgtttgctcacattctttcagccttctctcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgtaacatccctagtgaggctccagcctaatgagccccttattttctttttcttccctccccaggtctcgtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattgggtcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcacccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaaaagtg

SEQ ID NO: 453809 - DNA, 2188 bp, Homo sapiens
cactggcattgatgtatgagaaccagtgcacctaaagatatcataagataagaatattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattgggtcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaaaagtg

SEQ ID NO: 453810 - DNA, 4332 bp, Homo sapiens
  misc_feature (3181)..(3181): n is a, c, g, or t
agacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtaagggcgccgttggaggactgaaggccagcgccgaggctggagttactgccactgcctccgcgcttgggaagggaaatcgggtcctcggccagtcgcactccgagaagccgaacttttcagccaatcccttctacccgtcgccctcggggacttgggtcggtccgctgggctccgctagggcttaattcaatggactgtttacacccgggcgaacacaaggcggggcgcggggaggagcgtcacagagggggccaagcaaagaaaaatatttccgccggccaaatcgcgtctctaagcggttttcagaaggcgtgaagcttgctggctcttctttttcctatcgctacatgacaagctaacagagagagcggagagtttgtgcttttctttccggttccccctctgagctgctgcccagtggttcggtctttcccgctttcccctcccctcccccgttcaatcagcggcggtggcttccgtcttaaaggggccgcggcggccgggggaggaggaggtgggacgccccgcggcctacgctcctggcctccccgccttggcctggccgtttaaccgattctttcgcccgcaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgngagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccgtctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgatgtaccaaggcagcaggggcttttacctgctaagcggcaatcctttggccctgagaatttgggagagaacagtgcatcaggccaggctcagcaatatgtttgctcacattctttcagccttctctcaccccccgtaccacgacgtgtccacgctagggggatctctagaacgaccgcagcatccatgtcaggata

SEQ ID NO: 453811 - DNA, 943 bp, Homo sapiens
ctgctggcccttacgcgcctgccccttacgcctctgctggcccttacgcgcgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaaaagtg

SEQ ID NO: 453812 - DNA, 7072 bp, Homo sapiens
  misc_feature (2966)..(2966): n is a, c, g, or t
agacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtaagggcgccgttggaggactgaaggccagcgccgaggctggagttactgccactgcctccgcgcttgggaagggaaatcgggtcctcggccagtcgcactccgagaagccgaacttttcagccaatcccttctacccgtcgccctcggggacttgggtcggtccgctgggctccgctagggcttaattcaatggactgtttacacccgggcgaacacaaggcggggcgcggggaggagcgtcacagagggggccaagcaaagaaaaatatttccgccggccaaatcgcgtctctaagcggttttcagaaggcgtgaagcttgctggctcttctttttcctatcgctacatgacaagctaacagagagagcggagagtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgngagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccgtctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgatgtaccaaggcagcaggggcttttacctgctaagcggcaatcctttggccctgagaatttgggagagaacagtgcatcaggccaggctcagcaatatgtttgctcacattctttcagccttctctcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgtaacatccctagtgaggctccagcctaatgagccccttattttctttttcttccctccccaggtctcgtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattgggtcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaaaagtg

SEQ ID NO: 453813 - DNA, 2828 bp, Homo sapiens
agacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtaagggcgccgttggaggactgaaggccagcgccgaggctggagttactgccactgcctccgcgcttgggaagggaaatcgggtcctcggccagtcgcactccgagaagccgaacttttcagccaatcccttctacccgtcgccctcggggacttgggtcggtccgctgggctccgctagggcttaattcaatggactgtttacacccgggcgaacacaaggcggggcgcggggaggagcgtcacagagggggccaagcaaagaaaaatatttccgccggccaaatcgcgtctctaagcggttttcagaaggcgtgaagcttgctggctcttctttttcctatcgctacatgacaagctaacagagagagcggagagtttgtgcttttctttccggttccccctctgagctgctgcccagtggttcggtctttcccgctttcccctcccctcccccgttcaatcagcggcggtggcttccgtcttaaaggggccgcggcggccgggggaggaggaggtgggacgccccgcggcctacgctcctggcctccccgccttggcctggccgtttaaccgattctttcgcccgcaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccgaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaaaagtg

SEQ ID NO: 453814 - DNA, 4948 bp, Homo sapiens
atttttgcttttacaatgggagctgcagaagcgtagggaagaagctgaagaaaaaaagggggcgtctcccctttaaagacttgcaaagattgagagagaaagagagagagtcaagaacagagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 453815 - DNA, 1856 bp, Homo sapiens
atttttgcttttacaatgggagctgcagaagcgtagggaagaagctgaagaaaaaaagggggcgtctcccctttaaagacttgcaaagattgagagagaaagagagagagtcaagaacagagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 453816 - DNA, 3839 bp, Homo sapiens
atttttgcttttacaatgggagctgcagaagcgtagggaagaagctgaagaaaaaaagggggcgtctcccctttaaagacttgcaaagattgagagagaaagagagagagtcaagaacagagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctgccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 453817 - DNA, 4726 bp, Homo sapiens
gctgggtgcagaggctgccgcagacccagcggccatcgcctccctcaatcccaatatccattgtctcccaccccacctggccctccacttcccccacaaccatggcgcacgaatccgagaggagctctcgtctcggggtgccctgcggggagccggcagagctcggaggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagaccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 453818 - DNA, 1650 bp, Homo sapiens
gctgggtgcagaggctgccgcagacccagcggccatcgcctccctcaatcccaatatccattgtctcccaccccacctggccctccacttcccccacaaccatggcgcacgaatccgagaggagctctcgtctcggggtgccctgcggggagccggcagagctcggaggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtctggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagactttgggagaccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaaccaa

SEQ ID NO: 453819 - DNA, 1254 bp, Homo sapiens
tcaaagagtattcaatagtatgaatatacaatgtactcatactctttgtcattttgattaagccatagttgttaaagagtttaatgctcagtttttttttctttcaactagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453820 - DNA, 724 bp, Homo sapiens
cagcactttgggaggctgaggcaggaggattgcttgagcccaggagttcaagatcagcctgggcaacatagcaagacctctgtctctattaaaaaaaaaaattagccaggcctgggactacaggcatgtgccaccacacctggctaatttttgtatttttttgtagagacggggtattgccatgctgcccaggctgggagaaacaggtcttcttttctggcggcagagtctgtgatcatgagcaggccaggggttctggaatagggaaacttgtggggattaattgaagctgcctcatagggatcttggcaatagctaagggagtatgtacgctgttggacattttatggaaggatttaaacctttagaaattggtaggatttggagctccagccacctgcaataacaggtgattgctaataggcctttaaggaaacaccacctgttcagctgccgcctgtagtgaagcttgttttctttagggaagataggagcaagtgcctggttctttgttgcatttgtgtttaactttttccaatctctttcagttacagttgaaagcagagtgtaacaagggatatgtcaaggtaaagcaggtaggtgtatttataacttggaattttatactcgatgattttcttatgctgttgactttagagtgtctgtgccagccagtgaaggcttctctgtcatgtatggaagtgatggagtaatataggtgaac

SEQ ID NO: 453821 - DNA, 521 bp, Homo sapiens
cttctttgtgtacttgcccttgttctctttgcttggaatcttctccctgtttcctttctccacctcctgctcctcacctaattaggctgctccttttcacctaattaacccagtttataaatgggactcagttataaagtttaggtccacctcctccaggaaattttttcctgacacctccttcctcccaatctcggttgggtactctagcattgtgcttccaccctttgcacagagcaatcatcatgtttaccacatctactattaacataattgtttgtgtttttctcctccacaagatttattttttttagatgaggtgttgctgtgttgcccaagctggacttgaacccctaggctcaagcaatccttccacctcagtctcccaagtagcagggactacagctactccagaggctgaggctggaggaccactttagcccaaggaagttgaggctgcagtgagctgtgatgacgccctgcacccaatctgggcaacagagtgagaccctgtctcagaa

SEQ ID NO: 453822 - DNA, 1996 bp, Homo sapiens
ctctgacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453823 - DNA, 2153 bp, Homo sapiens
ctctgacgtcatcccgcagcgccggaagcggtgaggcacagatgagtaacgtgaatttgtccgtctccgacttctggaggtaaggcggtcgtcagcctatctcttctgctggctgggctcaatgccgcggatttattttttttagatgaggtgttgctgtgttgcccaagctggacttgaacccctaggctcaagcaatccttccacctcagtctcccaagtagcagggactacagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453824 - DNA, 2107 bp, Homo sapiens
gctcgaccggcttcccggcgctcgtggaatcttctggagcccttttctccactcagcgagcctgagagtgcggaagtctccggctggtggggcatggcccaggagcactgcaagtcctagggttcccaaacctgtggggtggccgcctgggcccgcgagggcgggaagggctcgagtacagtgacccagcgggagctgtgtgtgaacgggaaagctcttggaacagtcttgcccccccccccccccctcttacgggcgcctcttctctttttgggaacgtggcgagcaaaaaatgcttgagccagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453825 - DNA, 1881 bp, Homo sapiens
ctctgacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453826 - DNA, 1834 bp, Homo sapiens
ctctgacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453827 - DNA, 1936 bp, Homo sapiens
ctctgacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453828 - DNA, 2032 bp, Homo sapiens
ctctgacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagagtagctgggatttgacttttcttccttgcctgcagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453829 - DNA, 1780 bp, Homo sapiens
ctctgacgtcatcccgcagcgccggaagcggtgaggcacagatgagtaacgtgaatttgtccgtctccgacttctggagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453830 - DNA, 990 bp, Homo sapiens
gctcgaccggcttcccggcgctcgtggaatcttctggagcccttttctccactcagcgagcctgagagtgcggaagtctccggctggtggggcatggcccaggagcactgcaagtcctagggttcccaaacctgtggggtggccgcctgggcccgcgagggcgggaagggctcgagtacagtgacccagcgggagctgtgtgtgaacgggaaagctcttggaacagtcttgcccccccccccccccctcttacgggcgcctcttctctttttgggaacgtggcgagcaaaaaatgcttgagccagtttacaaagaaaaggagtcggagccagggcggttatgtgggacgtggatgcagacgcaggcggaggcgccaactgcggggatggctagggtgatcacagctgccccgggggcgcggacaccccggcagctccggccagcggagctcccccaccgcacgtgtcaggtcctagcagaaacgcagcgtctgtggccaagggccaggaatgcggccgcacatattcaccctcagcgtgcctttcccgacccccttagaggtggaaattgcccatgggtccctggctccagatgccgaaccccaccaaagggtggttgggaaggatctcacagtgagcggcaggatcctggccgtccgctggaaagctgaagactgttgcctgctccgaatttcccttatcaactttctcgaccatctttctctggtggtgcggaccctgcagcactttgggcccccagtttcccgctaagcctggcctgggaaaatggggcgaggtctaaccttgcgtctcctcctaggcagtgcatccatcctccctagggcagggaattcccacagttgctactttcccgggagggcctcatggtcggcctgtactgcctttgtgtgctcaggggtcccttgttttctctggttcttaaatgtttgttaccacagaaaataaaactgagctactattaaaaagaaaa

SEQ ID NO: 453831 - DNA, 131 bp, Homo sapiens
ggtatctcatattggttttccagagtagctgggatttgacttttcttccttgcctgcagctgtgatcgagatggtacaagaggctggtagagtaactgtccgagatgggatgcctgagctcttgaagctgc

SEQ ID NO: 453832 - DNA, 1995 bp, Homo sapiens
attttcacaacagcctcctgagtcccatcattatcatggtttataggtgaggaaattgagactagggtggtgaagtcacttgcctcaagatgaacagctggtagatcacatgcgtggtggcaccgggtgtggccctggaggactcgtgctagtggatctgtttttctagtgattcttttgttttgtcccttagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453833 - DNA, 2230 bp, Homo sapiens
ctctgacgtcatcccgcagcgccggaagcggtgaggcacagatgagtaacgtgaatttgtccgtctccgacttctggaggtaaggcggtcgtcagcctatctcttctgctggctgggctcaatgccgcgggtgagcgttcggccgaggctgctcctacccttgagtgatgtgccttgaatgacgctgctttcattcgctgctctcacggctgctttctccgtcctcccctgttactaccttgggctgtttcagcgggcgctcgcgttggtcttcgacccactttgcgtttgttcacgtgtgctcccgacacctagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453834 - DNA, 2038 bp, Homo sapiens
ctctgacgtcatcccgcagcgccggaagcggtgaggcacagatgagtaacgtgaatttgtccgtctccgacttctggaggtaaggcggtcgtcagcctatctcttctgctggctgggctcaatgccgcggatttattttttttagatgaggtgttgctgtgttgcccaagctggacttgaacccctaggctcaagcaatccttccacctcagtctcccaagtagcagggactacagagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453835 - DNA, 2047 bp, Homo sapiens
ctctgacgtcatcccgcagcgccggaagcggtgaggcacagatgagtaacgtgaatttgtccgtctccgacttctggaggtaaggcggtcgtcagcctatctcttctgctggctgggctcaatgccgcggagtgatgatgcgggtgtgctggttggtgagacaggacagccggcaccagcgaatcagacttccacatttggaagcagttgtgattgggcgtggcccagagaccaagatcactgataagaaatgttctcgacagcaagtacagttgaaagcagagtgtaacaagggatatgtcaaggtaaagcaggtaggagtcaatcccaccagcattgactcagtcgtaattgggaaggaccaagaggtgaagctgcagcctggccaggttctccacatggtgaatgaactttatccatatattgtagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453836 - DNA, 1885 bp, Homo sapiens
ctctgacgtcatcccgcagcgccggaagcggtgaggcacagatgagtaacgtgaatttgtccgtctccgacttctggaggtaaggcggtcgtcagcctatctcttctgctggctgggctcaatgccgcggagtgatgatgcgggtgtgctggttggtgagacaggacagccggcaccagcgaatcagacttccacatttggaagcagttgtgattgggcgtggcccagagaccaagatcactgataagaaatgttctcgacagcaagagtttgaggaagaggcaaagaaccctggcctggaaacacacaggaagagaaagagatcaggcaacagtgattctatagaaagggatgctgctcaggaagctgaggctgggacagggctggaacctgggagcaactctggccaatgctctgtgcccctaaagaagggaaaagatgcacctatcaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453837 - DNA, 1880 bp, Homo sapiens
ctctgacgtcatcccgcagcgccggaagcggtgaggcacagatgagtaacgtgaatttgtccgtctccgacttctggaggtaaggcggtcgtcagcctatctcttctgctggctgggctcaatgccgcgggtgagcgttcggccgaggctgctcctacccttgagtgatgtgccttgaatgacgctgctttcattcgctgctctcacggctgctttctccgtcctcccctgttactaccttgggctgtttcagcgggcgctcgcgttggtcttcgacccactttgcgtttgttcacgtgtgctcccgacacctagtgatgatgcgggtgtgctggttggtgagacaggacagccggcaccagcgaatcagacttccacatttggaagcagttgtgattgggcgtggcccagagaccaagatcactgataagaaatgttctcgacagcaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453838 - DNA, 1756 bp, Homo sapiens
  misc_feature (22)..(22): n is a, c, g, or t
  misc_feature (103)..(103): n is a, c, g, or t
  misc_feature (107)..(107): n is a, c, g, or t
  misc_feature (110)..(110): n is a, c, g, or t
  misc_feature (115)..(115): n is a, c, g, or t
  misc_feature (150)..(150): n is a, c, g, or t
  misc_feature (152)..(152): n is a, c, g, or t
  misc_feature (156)..(158): n is a, c, g, or t
  misc_feature (160)..(161): n is a, c, g, or t
  misc_feature (172)..(174): n is a, c, g, or t
  misc_feature (176)..(176): n is a, c, g, or t
  misc_feature (178)..(180): n is a, c, g, or t
  misc_feature (183)..(184): n is a, c, g, or t
  misc_feature (186)..(186): n is a, c, g, or t
  misc_feature (188)..(190): n is a, c, g, or t
  misc_feature (192)..(192): n is a, c, g, or t
  misc_feature (194)..(194): n is a, c, g, or t
  misc_feature (197)..(197): n is a, c, g, or t
  misc_feature (201)..(201): n is a, c, g, or t
  misc_feature (204)..(204): n is a, c, g, or t
  misc_feature (208)..(208): n is a, c, g, or t
  misc_feature (213)..(213): n is a, c, g, or t
  misc_feature (215)..(215): n is a, c, g, or t
  misc_feature (217)..(219): n is a, c, g, or t
  misc_feature (223)..(223): n is a, c, g, or t
  misc_feature (232)..(232): n is a, c, g, or t
  misc_feature (235)..(236): n is a, c, g, or t
  misc_feature (241)..(241): n is a, c, g, or t
  misc_feature (249)..(249): n is a, c, g, or t
  misc_feature (251)..(251): n is a, c, g, or t
  misc_feature (259)..(260): n is a, c, g, or t
  misc_feature (272)..(272): n is a, c, g, or t
tgccggcgctttccgccggctnttgccgtcccggcgtcgcgtcctgggcggcgccttcttgcgtgtccttgggccgcggccgcgtgccgtgccggtggggcgntgtngcnctggncctgcctttctggctctcttgtcgggtttgggggngngggnnngnngggtggggtgnnngngnnnggnngngnnngngntgngggnagngtgnttgtntngnnngggntggtggtgnggnnggtgngggtgggngnggggtggnnggtgggaggaantgtggggaatggtgtgtgggggtaaagaagggaaaagatggaggtatgaaaaaggaatccctgggccactggagtcaaggcttgaagatttctatgcaggaccccaaaatgcaggtttacaaagatgagcaggtggtggtgataaaggataaatacccaaaggcccgttaccattggctggtcttaccgtggacctccatttccagtctgaaggctgtggccagggaacaccttgaactccttaagcatatgcacactgtgggggaaaaggtgattgtagattttgctgggtccagcaaactccgcttccgattgggctaccacgccattccgagtatgagccatgtacatcttcatgtgatcagccaggattttgattctccttgccttaaaaacaaaaaacattggaattctttcaatacagaatacttcctagaatcacaagctgtgatcgagatggtacaagaggctggtagagtaactgtccgagatgggatgcctgagctcttgaagctgccccttcgttgtcatgagtgccagcagctgctgccttccattcctcagctgaaagaacatctcaggaagcactggacacagtgattctgcagagcctgagctgctgctgtggtgtggcccactggagcaaactgctggcacctattctgggttgcttgtgaacttctactcatttcctaaattaaaacatgcagctttttcacaaatttattctattattgagtggccacaatgtagagtggctcaaagtacttcaggattaggaatttgggtttgtcatagatgtattctctggtgagggtggctgggatatacctgacccaccatcttcagaaggacccatgtcaggtctgaccattgggagcaaagccatgttcacactgacctaatgcagagtatggaagcattgggctggttatacatttctgtttcttagatttatcctccgcctctgtaggcatggacaacctttaatcagagcatctagagtggcctcttgtttatcctgaagatactgatgggtcttgttttctgttagtctgttttgtaatattcttttcccttccttcatggggaggcttagtttgtccagtccttccatgcccttctatcccagattacctaaatgttcccttctcaggaattctgtctcatcagttcttcacagtgagaaaagaggctagatgatggtgtggggggttggagttttcttctaataccgagggttcctggctgtgaggaaacagccacatgttcgtcatgattgagctgtgaagtcttcttggacctgttgtctgaaaataaagttaatttgtttgaggcatctctcttaagtaggtggaaactattgaagttcagctaacaatcacagcataggttctgatgcatggaaaggtggttggtgaatgaaaaagttgcgtagagccactactttctttttccctgagaataaatttggataaaacagt

SEQ ID NO: 453839 - DNA, 398 bp, Homo sapiens
gttggtgctcgaccggcttcccggcgctcgtggaatcttctggagcccttttctccactcagcgagcctgagagtgcggaagtctccggctggtggggcatggcccaggagcactgcaagtcctagggttcccaaacctgtggggtggccgcctgggcccgcgagggcgggaagggctcgagtacagtgacccagcgggagctgtgtgtgaacgggaaagctcttggaacagtcttgcccccccccccccccctcttacgggcgcctcttctctttttgggaacgtggcgagcaaaaaatgcttgagccaggtgggtctagtccccagaccaatagcataggccttgggtcttgctgtttttcacgcgtggtccaaggcggcataattaatcaaattg

SEQ ID NO: 453840 - DNA, 480 bp, Homo sapiens
ggtccggaattcccgggtcgaatactactatataattcgaggccgcgtcgactcgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaa

SEQ ID NO: 453841 - DNA, 1443 bp, Homo sapiens
tgagtagacataaagaactagagtcaagaaacagtgaatcgggggaaaaaaggaactagagagccacctgtcccttagtaaaggtaatacgaataaaagcctctctactcttctgactccaacgtcttttctctctttgaagcgttaacccgacttgcctctgtcttctttgctacagtttggtgaagatgtttatgcttccttcgggaggagctgaataggtgctaggcagctagctgtgcgcttagaagaaacgagtgtattgggtctgtttttaccaagctgctgagttggttggtggttgtgagcagcaggacgtgtttcctgagagaaatggagatttacaccatcctgtgcttgtctaggaaggcgtccaaatatttatttcctaggcatttcagtaggagtattggtcatgctggtttacggaggtggtcagtgacacgcctaatttcgttggaaactagaattacgtgcggagatttcgtcgaatagtgcctattcgcgttccgagggcacatcttatgcatagttagggctatcagctttatgatatgccaccgatagtatttcccagtgcaggagtatttcataaacagctggaatcaactgaagtgactcatcgaacactaatggttgtttactcattgcagatagcgtcctctgttccttgagtttcactcatgtctccctgttgctttccctaccccattttgaattatttgacagcgtttgtggtttggtgtttggagtattagactaggcggctgaatgacaaatatgggcttggttttgctgttaatctgaagtatgaccttggaaaattgggcaattgtgacttttgtcttttcgcgttctttatctgtagaatggaggagatgccaatcattatttcttgtattggagttgttagggttatataaatttttttttaaataaacataaaattacacacttgtacctactggctcttttaaaggataggtgggcatccttttttggattattcgtgctccttggttgtcttgtcagtttttttctttttatattcagggtggatgctgatatactgcttgacttactgcgtatttgaagattatcctgtttgattttccatctaaactgatccaggctgggacttttcaagaggggatcccttccgtttaaacatctccctctttcaggtttggattgattttgaaagaatccttgaggcaacgaagcagagttgtgaaatgaaaaacatttttcactctttgcagccactacctttcatagtctgacttcttaaagtgagacttatatttagtaattctgcttcataacctcatttattctcattcactgcaaattcacatctattgccatcactccactgaaactagttttccatgccaaaagctgctcctctcccaagtaatactatcatgaccaacaaaacca

SEQ ID NO: 453842 - DNA, 3200 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctg

SEQ ID NO: 453843 - DNA, 2443 bp, Homo sapiens
atttgccttattctgtaagattgggcttagactcaccagtcacactgtctgtctgctgtagtctactgtattctgtagtctactgtattctgtgcactgtttaaactttctggcagctgcttacatcttttggatctagaagtaaaaaacaagatgatattcactgaattgaactatttacatatatgaaactacctcttaaagattagttttcctttttatatgcaagttttgtgaacttacagtattacattctttttcattcatgtatttaatatgtatgctttcttcagggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaa

SEQ ID NO: 453844 - DNA, 2209 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagattta

SEQ ID NO: 453845 - DNA, 2238 bp, Homo sapiens
ctttttggaagagtatttctattttaagttattcctcagacttgaaaggaaacacagaccaactttccagtgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttagaaatttgttgtaagaactgatgccggggctgggtgcggaggctcacgcctgtaatcccagcacttcaggaagtcaaggcaggtggatcacctgaggacaggagttcaagaccagcctggccaacatggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattgtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctg

SEQ ID NO: 453846 - DNA, 2292 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtatggctcagcgctgcgcgggcatacaactttctattctatgattaatatgtccaaaatctaactactcctcattggtccttggcagttttctatcttagtcatttgcagaaagagttccagcttgccaaaaccttttatatctaaaaggggggga

SEQ ID NO: 453847 - DNA, 1653 bp, Homo sapiens
aagagataaatgccaaatattaggacatgctatgtttgtgggaatgtggaggtgggatggagagtgactaatttggaagatatccaagaaccacttagggcgaaaggtggttagcatttcatttggagctgagaaaaatgttgtgagaagggtacatgacatttacactgttaggacaaatgctcagattctggaatcaatgtagtcttaaacagaagtgttactttgtggttatttttcctctgtagtgaaatatggttttgagtttgatttttcatatccaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctg

SEQ ID NO: 453848 - DNA, 1737 bp, Homo sapiens
acgtcattaccaggcacgcgcaggaaacatggcggcggcgggtgttgtgagcgggaaggtaggtaacggcctccaggaagacctcggcttttctctgggacggggatgcttttgctccctggcagctggttgggggagggacacgagggactttctgtgtccggacaacccgtggcgtccgtaggagaagactgggtggtaccagctggtttcccgagaatgccagttcagccgcggagttatagagccggctactgctccaaggccagctaggcctcggcgctcttctgccccagagcagagaggcttttattcgtattacctttactaagggacaggtggctctctagttccttttttcccccgattcactgtttcttgactctagttctttatgtctactcttctgactccaacgtcttttctctctttgaagcgttaacccgacttgcctctgtcttctttgctacagtttggtgaagatgtttatgcttccttcgggaggagctgaataggtgctaggcagctagctgtgcgcttagaagaaacgagtgtattgggtctgtttttaccaagctgctgagttggttggtggttgtgagcagcaggacgtgtttcctgagagaaatggagatttacaccatcctgtgcttgtctaggaaggcgtccaaatatttatttcctaggcatttcagtaggagtattggtcatgctggtttacggaggtggtcagtgacacgcctaatttcgttggaaactagaattacgtgcggagatttcgtcgaatagtgcctattcgcgttccgagggcacatcttatgcatagttagggctatcagctttatgatatgccaccgatagtatttcccagtgcaggagtatttcataaacagctggaatcaactgaagtgactcatcgaacactaatggttgtttactcattgcagatagcgtcctctgttccttgagtttcactcatgtctccctgttgctttccctaccccattttgaattatttgacagcgtttgtggtttggtgtttggagtattagactaggcggctgaatgacaaatatgggcttggttttgctgttaatctgaagtatgaccttggaaaattgggcaattgtgacttttgtcttttcgcgttctttatctgtagaatggaggagatgccaatcattatttcttgtattggagttgttagggttatataaatttttttttaaataaacataaaattacacacttgtacctactggctcttttaaaggataggtgggcatccttttttggattattcgtgctccttggttgtcttgtcagtttttttctttttatattcagggtggatgctgatatactgcttgacttactgcgtatttgaagattatcctgtttgattttccatctaaactgatccaggctgggacttttcaagaggggatcccttccgtttaaacatctccctctttcaggtttggattgattttgaaagaatccttgaggcaacgaagcagagttgtgaaatgaaaaacatttttcactctttgcagccactacctttcatagtctgacttcttaaagtgagacttatatttagtaattctgcttcataacctcatttattctcattcactgcaaattcacatctattgccatcactccactgaaactagttttccatgccaaaagctgctcctctcccaagtaatactatcatgaccaacaaaacca

SEQ ID NO: 453849 - DNA, 3162 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaa

SEQ ID NO: 453850 - DNA, 2951 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgaaaatgttgtcatgactccttgtcctacatctgcatttcaaagtaatgccttgcctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaa

SEQ ID NO: 453851 - DNA, 3146 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggaattgccacaagcagtctgtgagatccttgggcttcaaggcagtgaagttacaacaccagattcagacgttggtgaagacgctacactctctgccagtggagccagaaatgacagcccaacacagataccagtgtcctcagatgtctgcagattaacacctgcatgatcactgttcttgcttttttgggaagagacactttgttgcaaccctttttcaagtacttgaaagttgaaaatttgaaatcttggtattgatcatgctttaaggtttatgtaaagaaagtgtactgatgttcttacattaaagctttacaaagatttaaactaattatttttgtagttacttctaccaaatagcctttccttttcgataacattcctcagtatttttatagccaagtacattttattttcttgctgatgaactggaattggataaatattgcaagtggatgagttggaaattatgcactttgaaaaacattcactttgtttaagcttattgggtttcagatttgattaaattaaatgtggaggctttctatagcattctaagctgagaagtagattgttacccagtaatgaaataaaaaataaaaataaaaggatttttttctctattgtttacgacagtactcagcttaaatatttatgctggtcaaatgtgatttaaattggacattttcatcaatgcagtctaatgtgtagataaatatttcaaccataataagtggattggcagtatattttttacattgaacttttcttcacttgtatataaagattatatataagtacttatttatgagtataagaaaggttaggcatattttcattaactgaataaacgacttgatttatataacctggtttatcaaaatttaacatggcttcagtatgagatctttttcaaaactattttcttaaacatttatttcatgagattatgttcaaccctgtacctggtgtaattttaaaattaattgcttgtaacctcactttactaataatgtttattatctttcctaataatgcattaactgattaatcaggtgtttaaatttttataaaatactcttgcaaaaagtttatttgaaaaatttctagatggtctcatgagtttcaaaataataatttttgtgtatgaacaaagctgttgtttttaccatgcagtattgcatgattttaagttatgtggaattaacataactgattttgttttaattgtaagttgttaactcctgtatatatcattaaaataaatctgaagttgaagtagtgtttttagttaaattatacttagaaatagtctg

SEQ ID NO: 453852 - DNA, 1959 bp, Homo sapiens
acgtcattaccaggcacgcgcaggaaacatggcggcggcgggtgttgtgagcgggaagattatatatgaacaagaaggagtatatattcactcatcttgtggaaagaccaatgaccaagacggcttgatttcaggaatattacgtgttttagaaaaggatgccgaagtaatagtggactggagaccattggatgatgcattagattcctctagtattctctatgctagaaaggactccagttcagttgtagaatggactcaggccccaaaagaaagaggtcatcgaggatcagaacatctgaacagttacgaagcagaatgggacatggttaatacagtttcatttaaaaggaaaccacataccaatggagatgctccaagtcatagaaatgggaaaagcaaatggtcattcctgttcagtttgacagacctgaaatcaatcaagcaaaacaaagagggtatgggctggtcctatttggtattctgtctaaaggatgacgtcgttctccctgctctacactttcatcaaggagatagcaaactactgattgaatctcttgaaaaatatgtggtattgtgtgaatctccacaggataaaagaacacttcttgtgaattgtcagaataagagtctttcacagtcttttgaaaatcttcttgatgagccagcatatggtttaatacaaaaaattaaaaaggacccttatacggcaactatgataggattttccaaagtcacaaactacatttttgacagtttgagaggcagcgatccctctacacatcaacgaccaccttcagaaatggcagattttcttagtgatgctattccaggtctaaagataaatcaacaagaagaaccaggatttgaagtcatcacaagaattgatttgggggaacgccctgttgttcaaaggagagaaccggtatcactggaagaatggactaagaacattgattctgaaggaagaattttaaatgtagataatatgaagcagatgatatttagagggggacttagtcatgcattgagaaagcaagcatggaaatttcttctgggttattttccctgggacagtaccaaggaggaaagaacccaattacaaaagcaaaaaactgatgaatacttcagaatgaaactgcagtggaaatccatcagccaggaacaagagaaaagaaattcgaggttaagagattatagaagtcttatcgaaaaagatgttaacagaacagatcgaacaaacaagttttatgaaggccaagataatccagggttgattttacttcatgacattttgatgacctactgtatgtatgattttgatttaggatatgttcagggaatgagtgatttactttcccctcttttatatgtgatggaaaatgaagtggatgccttttggtgctttgcctcttacatggaccaaatgcatcagaattttgaagaacaaatgcaaggcatgaagacccagctaattcagctgagtaccttacttcgattgttagacagtggattttgcagttacttagaatctcaggactctggatacctttatttttgcttcaggtggcttttaatcagattcaaaagggaatttagttttctagatattcttcgattatgggaggtaatgtggaccgaactaccatgtacaaatttccatcttcttctctgttgtgctattctggaatcagaaaagcagcaaataatggaaaagcattatggcttcaatgaaatacttaagcatatcaatgaattgtccatgaaaattgatgtggaagatatactctgcaaggcagaagcaatttctctacagatggtaaaatgcaaggtatacagtgtttcaagtaattgcaagatttgtttgtttttggtgggttgagatcaagaaagatttttcttcttggaaataaaatagcaactttagtaagctgagggcaggcacaaagtattggctgg

SEQ ID NO: 453853 - DNA, 1298 bp, Homo sapiens
gattcaagtgctggctttgcgtccgcttccccatccacttactagcgcaggagaaggctatctcggtccccagagaagcctggacccacacgcgggctagatccagagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaacctgtctctggctcattgggcaggtagataagtcacctgagttcaaccttgcctctgaaatgtagtatgggaaagacttgtgtttctgcagcatggaactgagttatacaacaggagaggacagtccttccagtcaccgttctaaccaccaccccttcgtttgctgctgaatccacaagcctcacctccacattcccttctccaaggtccttccttggtgtcctgctctggcttccaaggtcacaagggcctc

SEQ ID NO: 453854 - DNA, 1224 bp, Homo sapiens
atatggcagtgaggaggctgggggtaatcggacgagggtccagagaagctggacccacacgcgggctagatccagagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaacctgtctctggctcattgggcaggtagataagtcacctgagttcaaccttgcctctgaaatgtagtatgggaaagacttgtgtttctgcagcatggaactgagttatacaacaggagaggacagtccttccagtcaccgttctaaccaccaccccttcgtttgctgctgaatccacaagcctcacctccacattcccttctccaaggtccttccttggtgtcctgctctggcttccaaggtcacaagggcctc

SEQ ID NO: 453855 - DNA, 727 bp, Homo sapiens
  misc_feature (19)..(19): n is a, c, g, or t
  misc_feature (63)..(63): n is a, c, g, or t
gtttggaaaggttgggggncccccaaacccaaggggggttaaagggaaaaaccccccccggcncccgggggcccgaaaaaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaacctgtctctggctcattgggcaggtagataagtcacctgagttcaaccttgcctctgaaatgtagtatgggaaagacttgtgtttctgcagcatggaactgagttatacaacaggagaggacagtccttccagtcaccgttctaaccaccaccccttcgtttgctgctgaatccacaagcctcacctccacattcccttctccaaggtccttccttggtgtcctgctctggcttccaaggtcacaagggcctc

SEQ ID NO: 453856 - DNA, 1249 bp, Homo sapiens
tgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaacctgtctctggctcattgggcaggtagataagtcacctgagttcaaccttgcctctgaaatgtagtatgggaaagacttgtgtttctgcagcatggaactgagttatacaacaggagaggacagtccttccagtcaccgttctaaccaccaccccttcgtttgctgctgaatccacaagcctcacctccacattcccttctccaaggtccttccttggtgtcctgctctggcttccaaggtcacaagggcctc

SEQ ID NO: 453857 - DNA, 1222 bp, Homo sapiens
gcccaccccaagccggtttcacaaactccgtttcttaccgtaaggtttctcccctctcgccgctcgggcaagctgatcacaggtgtgtcgggagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaacctgtctctggctcattgggcaggtagataagtcacctgagttcaaccttgcctctgaaatgtagtatgggaaagacttgtgtttctgcagcatggaactgagttatacaacaggagaggacagtccttccagtcaccgttctaaccaccaccccttcgtttgctgctgaatccacaagcctcacctccacattcccttctccaaggtccttccttggtgtcctgctctggcttccaaggtcacaagggcctc

SEQ ID NO: 453858 - DNA, 1069 bp, Homo sapiens
tgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaacctgtctctggctcattgggcaggtagataagtcacctgagttcaaccttgcctctgaaatgtagtatgggaaagacttgtgtttctgcagcatggaactgagttatacaacaggagaggacagtccttccagtcaccgttctaaccaccaccccttcgtttgctgctgaatccacaagcctcacctccacattcccttctccaaggtccttccttggtgtcctgctctggcttccaaggtcacaagggcctc

SEQ ID NO: 453859 - DNA, 833 bp, Homo sapiens
  misc_feature (636)..(636): n is a, c, g, or t
tgtccgcgcgggagcccaggccagctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctatggncgcaaccagcaaccaacccacacaaacgaggcacagcgcacacctcagccaagagaagaacgccaagacaacgacaacgccatgcacgaacagacaacacgaccacccacacatcaccgcaagcaacaacgagaacggcgaaaaaccagaataaccacccgagacaacaccagagacacaaaaacaaaaagcccacg

SEQ ID NO: 453860 - DNA, 676 bp, Homo sapiens
ccaggcacgaccgtacgttctgactgtggataaatcggatgcggtgccccccccatcccattcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453861 - DNA, 3789 bp, Homo sapiens
agaggcgtattgtggtataactgttgctgtatttattcaaatggacaatttgcaatagatattatacccaggacgacagataagtcaacacataaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453862 - DNA, 3780 bp, Homo sapiens
agcggagccagggtgggctccgccgaggagaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaacatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453863 - DNA, 1576 bp, Homo sapiens
attcagtgtgtttttgtggtgtctggtgctggtctttcctttccatatctagtgattccttcaggagctctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453864 - DNA, 2227 bp, Homo sapiens
agcggagccagggtgggctccgccgaggagaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggtaaaaacagaaaaggtggagagaaaaacatggtggattcctttctccccgtctgtgcaagcctgcctccaacctgggtgatcgttgacactcaccatttctgtgaaagacttttttttttttaacatattatactagatttgactaactcaatcttgtagcttctgcagttctccccacccccaacctagttcttagagtatgtt

SEQ ID NO: 453865 - DNA, 3834 bp, Homo sapiens
agcggagccagggtgggctccgccgaggagaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453866 - DNA, 3801 bp, Homo sapiens
agcggagccagggtgggctccgccgaggagaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453867 - DNA, 3957 bp, Homo sapiens
agcggagccagggtgggctccgccgaggagaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaaatatggaggcagcaagagcagtggacttaatcccatggatggagtatgaattccgcgtggtagcaaccaatacactgggtagaggagagcccagtataccatctaacagaattaaaacagacggtgctgcaccaaatgtggctccttcagatgtaggaggtggaggtggaagaaacagagagctgaccataacatgggcgcctttgtcaagagaataccactatggcaacaattttggttacatagtggcatttaagccatttgatggagaagaatggaaaaaagtcacagttactaatcctgatactggccgatatgtccataaagatgaaaccatgagcccttccactgcatttcaagttaaagtcaaggccttcaacaacaaaggagatggaccttacagcctagtagcagtcattaattcagcacaagacgctcccagtgaagccccaacagaagtaggtgtaaaagtcttatcatcttctgagatatctgttcattgggaacatgttttagaaaaaatagtggaaagctatcagattcggtattgggctgcccatgacaaagaagaagctgcaaacagagttcaagtcaccagccaagagtactcggccaggctcgagaaccttctgccagacacccagtattttatagaagtcggggcctgcaatagtgcagggtgtggacctccaagtgacatgattgaggctttcaccaagaaagcacctcctagccagcctccaaggatcatcagttcagtaaggtctggttcacgctatataatcacctgggatcatgtcgttgcactatcaaatgaatctacagtgacgggatataaggtactctacagacctgatggccagcatgatggcaagctgtattcaactcacaaacactccatagaagtcccaatccccagagatggagaatacgttgtggaggttcgcgcgcacagtgatggaggagatggagtggtgtctcaagtcaaaatttcagaaggaaaatccacatccttgagaagtaaaacagccaaagatcacagaagcatcagaaccatgtcttgagcccaaatattctctgttgctaaagttatataactagctattgacagaactagaggtgcacccaccctatccccaagtcttctcggcttactgctgcctgcctttggcatccttgtctacttggaattctgaatgtgttgtgacagctgctgttcccatcccagctcagaagacacccttcaaccctgggatgaccacaattccttccaatttctgcggctccatcctaagccaaataaattatactttaacaaactattcaactgatttacaacacacatgatgactgaggcattcgggaaccccttcatccaaaagaataaacttttaaatggatataaatgatttttaactcgttccaatatgccttataaaccacttaacctgattctgtgacagttgcatgatttaacccaatgggacaagttacagtgttcaattcaatactataggctgtagagtgaaagtcaaatcaccatatacaggtgctttaaatttaataacaagttgtgaaatataatagagattgaaatgttggttgtatgtggtaaatgtaagagtaatacagtctcttgtactttcctcactgttttgggtactgcatattattgaatggcccctatcattcatgacatcttgagttttcttgaaaagacaatagagtgtaacaaatattttgtcagaaatcccat

SEQ ID NO: 453868 - DNA, 2418 bp, Homo sapiens
agcggagccagggtgggctccgccgaggagaggaggggcgccggtggggagatgcgctcccaggtgtttgcagcggaagtgggaaacctgtagggtatggtccagctgtgccgcaccgaggcgagcaggagcagggaacaggtgtttaaaattatccaactgccatagagctaaattcttttttggaaaattgaaccgaacttctactgaatacaagatgaaaatgtggttgctggtcagtcatcttgtgataatatctattactacctgtttagcagagtttacatggtatagaagatatggtcatggagtttctgaggaagacaaaggatttggaccaatttttgaagagcagccaatcaataccatttatccagaggaatcactggaaggaaaagtctcactcaactgtagggcacgagccagccctttcccggtttacaaatggagaatgaataatggggacgttgatctcacaagtgatcgatacagtatggtaggaggaaaccttgttatcaacaaccctgacaaacagaaagatgctggaatatactactgtttagcatctaataactacgggatggtcagaagcactgaagcaaccctgagctttggatatcttgatcctttcccacctgaggaacgtcctgaggtcagagtaaaagaagggaaaggaatggtgcttctctgtgaccccccataccattttccagatgatcttagctatcgctggcttctaaatgaatttcctgtatttatcacaatggataaacggcgatttgtgtctcagacaaatggcaatctctacattgcaaatgttgaggcttccgacaaaggcaattattcctgctttgtttccagtccttctattacaaagagcgtgttcagcaaattcatcccactcattccaatacctgaacgaacaacaaaaccatatcctgctgatattgtagttcagttcaaggatgtatatgcattgatgggccaaaatgtgaccttagaatgttttgcacttggaaatcctgttccggatatccgatggcggaaggttctagaaccaatgccaagcactgctgagattagcacctctggggctgttcttaagatcttcaatattcagctagaagatgaaggcatctatgaatgtgaggctgagaacattagaggaaaggataaacatcaagcaagaatttatgttcaagcattccctgagtgggtagaacacatcaatgacacagaggtggacataggcagtgatctctactggccttgtgtggccacaggaaagcccatccctacaatccgatggttgaaaaatggatatgcgtatcataaaggggaattaagactgtatgatgtgacttttgaaaatgccggaatgtatcagtgcatagctgaaaacacatatggagccatttatgcaaatgctgagttgaagatcttggcgttggctccaacttttgaaatgaatcctatgaagaaaaagatcctggctgctaaaggtggaagggtgataattgaatgcaaacctaaagctgcaccgaaaccaaagttttcatggagtaaagggacagagtggcttgtcaatagcagcagaatactcatttgggaagatggtagcttggaaatcaacaacattacaaggaatgatggaggtatctatacatgctttgcagaaaataacagagggaaagctaatagcactggaacccttgttatcacagatcctacgcgaattatattggccccaattaatgccgatatcacagttggagaaaacgccaccatgcagtgtgctgcgtcctttgatcctgccttggatctcacatttgtttggtccttcaatggctatgtgatcgattttaacaaagagaatattcactaccagaggaattttatgctggattccaatggggaattactaatccgaaatgcgcagctgaaacatgctggaagatacacatgcactgcccagacaattgtggacaattcttcagcttcagctgaccttgtagtgagaggccctccaggccctccaggtggtctgagaatagaagacattagagccacttctgtggcacttacttggagccgtggttcagacaatcatagtcctatttctaaatacactatccagaccaagactattctttcagatgactggaaagatgcaaagacagatcccccaattattgaaggaacaacagatacagtatcaaattatgacacttcccttacccaaattaatgcactggtacacacagtggctcatatttaacttcccccagattcccaatacacactggggggaaaaaaactaaatcatcgggagtcacttgccaacttggaagttgatatttctttactataaacattctaagactataagttctctggcatgagtatctctgcaatcat

SEQ ID NO: 453869 - DNA, 2255 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453870 - DNA, 1065 bp, Homo sapiens
  misc_feature (11)..(11): n is a, c, g, or t
  misc_feature (13)..(13): n is a, c, g, or t
  misc_feature (18)..(18): n is a, c, g, or t
  misc_feature (21)..(21): n is a, c, g, or t
tggcctaaggngntaacngtnactccccccccgcgattaatagcgaggcctgggtggcgcctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtggcctgtctgtgagatgagaagaagaccagactgaagcctgttcaccatatgccaggcagtgctttctgcagacccccttgcagagaccttgtgatggagaattatacccatttgacagacgagggaactgtggctggtttcaagaagccatggaggccgggcacggtggctcacgcctgtaatcccagcactttgggaggctgaggcgggcggatcatgaggtcaagaggtcgagaccatctggccaacatggtgaaaccccgtctctgctaaaaatacaaaaattattagctg

SEQ ID NO: 453871 - DNA, 871 bp, Homo sapiens
tggctacctggcttctttttgcccaagtgatttggtgaaacaaagcctcttcctccagcggacttggactcttaagtcaggggtgtcgtgtgtccacgctgtactttgtatacgcctctccctggccaggatctcaccctggcagggcaagggcaaaacgggccctaactgtaaggtgggtgggctgggataaggaggcctggaagaggccagataaagccagccccaaggtctggaagcctcccaagcatagccccctcccctcccacccacctgcctgtctgcgtgcttacctttaacctccacccagttgttacttaactcgcggtaaggttctgaccagtcccatgctccactccagaaacccgccagggaggctaagtccctgggctgaccctaggatgagggcaggaacctatcaggtaaaacctttctccctgcacactggaaaggccagaacttctgcccccagtcctgtcaggggaggggaggccttggcgtctcccaaatcacgttttctgggtcaacaagcctcacagctctagttaaatcctgggcagagctggcttggcagagatgcccacacctgtgcgtcacttcgtgccctacccagaaggggagcaggaaaccaagggatgaaaggtgctgggtccctggctgcctccttgcccatggctgagaagttctggtgggaaggaaccatggagggcccatctggatatccttcctcagctaaaactgcctccttccaggtaggagaacccggtgaccaggcaggtggcctttcctgtctaagcctcagtttcttgggggcgatgctgccagcccctcacagggctcagcgcagcacccagcatgcttggagggtgag

SEQ ID NO: 453872 - DNA, 2512 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatgaaaaaaaaaaaaaaaaaaaaaaaaaaaaaaaaaaaaaaacaaaaaaaaaaaaaaaaagaaaagaacacacaacgaaaagagaagagagcgggacagagggcgagagagagaaagaaggagggaggagagcagcgggagagggggaagggaagaaggaaggagagagaggggggggagagagaggggggagggagggagagcggcagaggaggggggggggcggacagggggagggagg

SEQ ID NO: 453873 - DNA, 2714 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactgacccttgaccccctgctccctcagcagagacggagggaggggctgctggtggtcagggacctgcactgtgtagagggagcctggctgtgtggcctggaacaagtccctccctccctgtgcgcctcaggtggcctgtctgtgagatgagaagaagaccagactgaagcctgttcaccatatgccaggcagtgctttctgcagacccccttgcagagaccttgtgatggagaattatacccatttgacagacgagggaactgtggctggtttcaagaagccatggaggccgggcacggtggctcacgcctgtaatcccagcactttgggaggctgaggcgggcggatcatgaggtcaagaggtcgagaccatctggccaacatggtgaaaccccgtctctgctaaaaatacaaaaattattagctg

SEQ ID NO: 453874 - DNA, 2207 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453875 - DNA, 2286 bp, Homo sapiens
agactcccatttttgccagagctggaaagatgccatactctctgttgcttaacctacaggctaggctaacagtgctggcatggcaggcgggcctggtactggccttgttgccctggcttggccactggtctgctggctgtctctgtgcctgtggaccctgagtgagccttaacctactatctgggcactgtggttgccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453876 - DNA, 2368 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggtatcaggcgggccagcgggccagcgggcctgggcgcgacgacacgtgggcctgcgctgagccgcagaacatccgggctccgctagccgagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453877 - DNA, 2314 bp, Homo sapiens
ccctgtctcaaaaataaataaataaaaactacaatcatttttgggataaaaacctagccttcaacttgggcccacatggccttgagggccagcccagggctgcagcttgaacattggttgtgggctttgtctctgagagctgtaagacagatgacattgtgggacagatgtcagcagagtgactgattggtatgggactgttggagcccatagaatgtgcaagaccagcctgggtgaggaggctgtcttagttgagaccaacgtggtgaatagggtgagccaggtgcagaggcctggagatagaagatggggaggactggggggctacagatagtccggggggatggggcaccaggaacaaaccgagggacacaggagagatgaggcacggaggccagtagcatcagtccctgcagggtgggggaaggccaggacgctcgggaagggagtcctgatgaccccagctgtcccggcagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453878 - DNA, 2205 bp, Homo sapiens
tgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453879 - DNA, 1491 bp, Homo sapiens
  misc_feature (6)..(6): n is a, c, g, or t
  misc_feature (9)..(9): n is a, c, g, or t
  misc_feature (11)..(11): n is a, c, g, or t
  misc_feature (17)..(17): n is a, c, g, or t
  misc_feature (20)..(20): n is a, c, g, or t
gggggnggngnaaaaantangcaggtacgaggctgggtgttactgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453880 - DNA, 2059 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453881 - DNA, 2116 bp, Homo sapiens
tgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453882 - DNA, 1050 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcacacagttggaagccatggaactgtacctggcacggagtgggctgcaggtggaggagcttggaccggctgaacatcatccacgtcactgggacgaaggggaagggctccacctgtgccttcacggaatgtatcctccgaagctatggcctgaagacgggattctttagctctccccacc

SEQ ID NO: 453883 - DNA, 639 bp, Homo sapiens
tgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453884 - DNA, 418 bp, Homo sapiens
tacgcctgtagttccagctacttgggagactgaggcaggagaatcactcgaacccgggaggcagacgttgcagtgagccgagattgcgccacagcactccagcctgggtgacagagtgagacttcatctcgaaaaagaaaagaaaagaaacatgagggatgagagacagtggtagcccagacccagggatgtgggggccagagataggagtgtggaggatgctaggtagccctttctctctccttcttccctccacacaaggtgtccctgccttcactgtgctccaacctgaaggtcccctggcagtgctgagggaccgagcccagcagatctcaagtaagtctgattggaatggggcagcggcagggtgggtttgtgtccctcctgtttgaggaggcactgcatcctctggggcctc

SEQ ID NO: 453885 - DNA, 2274 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453886 - DNA, 1047 bp, Homo sapiens
  misc_feature (6)..(6): n is a, c, g, or t
  misc_feature (9)..(9): n is a, c, g, or t
  misc_feature (11)..(11): n is a, c, g, or t
  misc_feature (17)..(17): n is a, c, g, or t
  misc_feature (20)..(20): n is a, c, g, or t
gggggnggngnaaaaantangcaggtacgaggctgggtgttactgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtggcctgtctgtgagatgagaagaagaccagactgaagcctgttcaccatatgccaggcagtgctttctgcagacccccttgcagagaccttgtgatggagaattatacccatttgacagacgagggaactgtggctggtttcaagaagccatggaggccgggcacggtggctcacgcctgtaatcccagcactttgggaggctgaggcgggcggatcatgaggtcaagaggtcgagaccatctggccaacatggtgaaaccccgtctctgctaaaaatacaaaaattattagctg

SEQ ID NO: 453887 - DNA, 1187 bp, Homo sapiens
tggctacctggcttctttttgcccaagtgatttggtgaaacaaagcctcttcctccagcggacttggactcttaagtcaggggtgtcgtgtgtccacgctgtactttgtatacgcctctccctggccaggatctcaccctggcagggcaagggcaaaacgggccctaactgtaaggtgggtgggctgggataaggaggcctggaagaggccagataaagccagccccaaggtctggaagcctcccaagcatagccccctcccctcccacccacctgcctgtctgcgtgcttacctttaacctccacccagttgttacttaactcgcggtaaggttctgaccagtcccatgctccactccagaaacccgccagggaggctaagtccctgggctgaccctaggatgagggcaggaacctatcaggtaaaacctttctccctgcacactggaaaggccagaacttctgcccccagtcctgtcaggggaggggaggccttggcgtctcccaaatcacgttttctgggtcaacaagcctcacagctctagttaaatcctgggcagagctggcttggcagagatgcccacacctgtgcgtcacttcgtgccctacccagaaggggagcaggaaaccaagggatgaaaggtgctgggtccctggctgcctccttgcccatggctgagaagttctggtgggaaggaaccatggagggcccatctggatatccttcctcagctaaaactgcctccttccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttaggtactggcttgtggggggatgtggtgtctgtgtcccaatggaccctggggggctatggaaccagccagtgcttcaggaccagggtcacccccaggaggtcagctgcatgtctctctgcccagtgtttattcattcaataaacattcagttagcaatcagcctgggcgacagagcaaactgctatctt

SEQ ID NO: 453888 - DNA, 2283 bp, Homo sapiens
tgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453889 - DNA, 2838 bp, Homo sapiens
tggctacctggcttctttttgcccaagtgatttggtgaaacaaagcctcttcctccagcggacttggactcttaagtcaggggtgtcgtgtgtccacgctgtactttgtatacgcctctccctggccaggatctcaccctggcagggcaagggcaaaacgggccctaactgtaaggtgggtgggctgggataaggaggcctggaagaggccagataaagccagccccaaggtctggaagcctcccaagcatagccccctcccctcccacccacctgcctgtctgcgtgcttacctttaacctccacccagttgttacttaactcgcggtaaggttctgaccagtcccatgctccactccagaaacccgccagggaggctaagtccctgggctgaccctaggatgagggcaggaacctatcaggtaaaacctttctccctgcacactggaaaggccagaacttctgcccccagtcctgtcaggggaggggaggccttggcgtctcccaaatcacgttttctgggtcaacaagcctcacagctctagttaaatcctgggcagagctggcttggcagagatgcccacacctgtgcgtcacttcgtgccctacccagaaggggagcaggaaaccaagggatgaaaggtgctgggtccctggctgcctccttgcccatggctgagaagttctggtgggaaggaaccatggagggcccatctggatatccttcctcagctaaaactgcctccttccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453890 - DNA, 2361 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaaggtgaccaggcagactgggggaagggagagacatggaaggcctgggagtctacgttttcatcctggcttcactgtgtgactggaacaacaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453891 - DNA, 2126 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcagtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453892 - DNA, 1533 bp, Homo sapiens
tcatatgtgatccggccctcggaagatcgcgtggcagaacgggggcatctttacaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453893 - DNA, 1830 bp, Homo sapiens
gcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggatgccgtgcgcatgctcaataccctgcagaccaatgccggctacctggagcaggtgaagcgccagcggggtgaccctcagacacagttggaagccatggaactgtacctggcacggagtgggctgcaggtggaggacttggaccggctgaacatcatccacgtcactgggacgaaggggaagggctccacctgtgccttcacggaatgtatcctccgaagctatggcctgaagacgggattctttagctctccccacctggtgcaggttcgggagcggatccgcatcaatgggcagcccatcagtcctgagctcttcaccaagtacttctggcgcctctaccaccggctggaggagaccaaggatggcagctgtgtctccatgcccccctacttccgcttcctgacactcatggccttccacgtcttcctccaagagaaggtggacctggcagtggtggaggtgggcattggcggggcttatgactgcaccaacatcatcaggaagcctgtggtgtgcggagtctcctctcttggcatcgaccacaccagcctcctgggggatacggtggagaagatcgcatggcagaaagggggcatctttaagcaaggtgtccctgccttcactgtgctccaacctgaaggtcccctggcagtgctgagggaccgagcccagcagatctcatgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgctggggagccaaaggcatccaggccagggctcctgtggcagctgcccctggcacctgtgttccagcccacatcccacatgcggctcgggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtggcctgtctgtgagatgagaagaagaccagactgaagcctgttcaccatatgccaggcagtgctttctgcagacccccttgcagagaccttgtgatggagaattatacccatttgacagacgagggaactgtggctggtttcaagaagccatggaggccgggcacggtggctcacgcctgtaatcccagcactttgggaggctgaggcgggcggatcatgaggtcaagaggtcgagaccatctggccaacatggtgaaaccccgtctctgctaaaaatacaaaaattattagctg

SEQ ID NO: 453894 - DNA, 1367 bp, Homo sapiens
cgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagatggagtcttgctctgtcgcccaggctggagtgcaatgtgctgcggcgcgggcccctcacctggtacctggacggtgcgcacaccgccagcagcgcgcaggcctgcgtgcgctggttccgccaggcgctgcagggccgcgagaggccgagcggtggccccgaggttcgagtcttgctcttcaatgctaccggggaccgggacccggcggccctgctgaagctgctgcagccctgccagtttgactatgccgtcttctgccctaacctgacagaggtgtcatccacaggcaacgcagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatg

SEQ ID NO: 453895 - DNA, 983 bp, Homo sapiens
agcttgaacattttgtgattacttttccctccccggatctagtccttttaaggagtaagtctaaagaatgaggccatgaagtcactatttcctcccacctcagtttgtctcctggtacttagctggcctatcgctttgtgtggcaatacccctgggtcgcttccccactcagccttctgtatctgctgttcacaggacatgccattatgtctttccagtacggatcacagtgctgccatatcacagaccctgccagccggcacagaaccatgcctcgtcacagctctgcccaactcacaggctgccaagatgaggccacaggtccacctagggcggcagatgctggtgctatttgtcacgacttttgccaaaacatgtacactgttgctcacatctttcgtaagaatggttgacactaaggggccatggaaaagcacttttaaaaaattatgtggtggaatcaaactcacagaggcagaaatgttagtgccgtgctctaaccaagtaagcttagtgttccccacagtgatctgtatctggcctgagtctcctcaagcagcaacccccactgtccagcatgtggaaggtagatccttatgacaacaccagacccatagttaccaggaaagaaaaaggaagctgagtgttgtgaaggggaagaaatcctttttataagaagtaatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaaaac

SEQ ID NO: 453896 - DNA, 6837 bp, Homo sapiens
  misc_feature (5)..(7): n is a, c, g, or t
  misc_feature (18)..(18): n is a, c, g, or t
  misc_feature (20)..(22): n is a, c, g, or t
  misc_feature (1864)..(1865): n is a, c, g, or t
tactnnncaaacatttcntnnnaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattnntgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagtatatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgcgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaata

SEQ ID NO: 453897 - DNA, 6625 bp, Homo sapiens
  misc_feature (1652)..(1653): n is a, c, g, or t
tcctctgctctgcagtccagattcttagcaatgtgatgcatttgtttttgtttttgtttttgttttcagccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattnntgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagtatatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgcgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaata

SEQ ID NO: 453898 - DNA, 3226 bp, Homo sapiens
cacgagggggactcccaagtagcaggagcagaggtcggtcacctgtggcattctgtttcattcccttttatcctttataggcaccttacagctcaaaacttttgtttcatttcatgccttacttatcaaaaaggcaggaaagtaggtatgatctctaaagtaaaaaaaaaaaaaaaaaaaaaaactttttatagaaagctcataaataatcatgtcattttgcaattttgttaccaaaatttcccccaagagttttcaaatattagttctgcaatgtggctatgaaatatgcactgaaatataccttttaatttgagaaccagtggttagaataagctgtgatataaagtattttcagtgtacttttaaaggaactataaggccctccagcataaacgctaaaagaatagatggtagcacaggccatgagggctgggggagagaagcagagtgaaccttagaaagatggctcagctatttggagcactggatattttactgaagtatatttactgaggcaccatcactgttttgactgtacagtatagtttttcataaatttcatcacatttactttgttcagaatctgggcttgaatctttgagttggacaaaagcctatggtttcttttaaaaagtttcatcttgagctaatgctacagtttaaataaaatgtatgaaaggtagttatcaaaaacaatttgtatatttaaaattctattttgacatccattttttacagcgaattatagcaggttatgtgaaatttaaaaataaattttaggaaatttttttatcttgtaagtaagaattataaatctatctcagttaaaagtaggatctttgtttttattcagatattttgaaagtttagaagcattttgtatgctactttggtatttcttaagtatagtcagcaggaaagggtaacctgttttatgcaaaatttttttaatttgtcaaatgtttttagtgtgtctactttctgaaatagtctcaatatcctgtctgtatcctaggcagataactacacaagaacaaaacgctatatagaaaagaaaatatttgaggaaatcttaaattccataagaaagtaattcttgcaagaatgttggctacatatttttttttctgtcctgaataaattacatcattaggtctgttgaagcttttgaagctaccactattctttctgggataaaggctaattactgatttatctgccctcaaaatcccagagttaattctaattgagtactaaattaacagtaagtagttaacacagagaactaaaatttaaccgcattatatcactgtatatatttctcatgatttttgctaattagagcatttacttaaccagtaataaactacacacacacacacacacacacacacgtatacgtgtgtgtgtgtatatacttggctctgacacaactctggtgcttaattaggatatgttctattatgtattttgaatgtttatcctgctagtgcgatgaacttttgttggaaaagcagaattagaaggaacagtttttcaatcagtttcatttggtaattacaggaaaaccttgagttgctctaatttaatttttccaattaatacatttagactttaaattgcatccgtaattctcttggctgaaaaacagtggtattttaagacagttttgttatacatgtgacttacttttgactcagcctgagaggaggaaatgtaaagagataagagatttggcccaaagcagcaagagactagtaaccttgagccaggacgaagccaagacaacgtgactcccaagtagcaggagcagaggtcggtcacctgtggcattctgtttcattcccttttaaaattatgagactttataggcagtgtaaaacatcagcaggcagcgatgtgataggatgtgcgaaaaagctggtctgataccatggctataattacagagctttagttcaattaggattttgtaaatgagcaaatgacctttttttccagtgccccttgtaatagttaatatgagtccatgcaatcttgtgatgccattctcctgaaggtgttgatttctggtacccagccagcttagctttggctgctggaagcacagtaggtactgatgattacttcctggaaatcttgacaggcttattgtactgtgtaatggggaaaagttaaagtataatgtttggtgttaataaatgactgatgtgaaaataggaacatgtgtctttaatatcaaatatggctttatttgcagtgaaatctaaattccttattctacagtagtattttcttgccctgtgttgtatattttcctaaatacatttttcctgacagtggctttaggccagttgaacacacttagactgaaagtgtttaacttaaagagatcagtccagaaaccatgataaattagaatctttatctggaattaccaaattaaaatttaaaatcatggtccagaagagaacaaacattcatggttttttttatcctactgctcatttttaggtctgtgtttacatctagtctctactatttgtgaagtatgtcattatttttttcaagttcttctttgacttaactgaaaaataatattccaaattcttaatgtaacatgaaaagagaaatacaatttttgcttaaaagacattttttaaaaagcgttcaattcagtaatcatttctgttaatacaggaagtttttttggcttgccagttatatactgtgggtattttttaaaatgtgctacccttgggttgtctcatatcaccttgcgtaatcatgtattacaaaggttgataattgtcatttctcagatgtctgtatgttacattggcagcagtaaaatgttttaatgttgttaccttttaaataattgtgttgtattaacatgcctcatattttctggggaaacttgaaatatatctaaacaaaaaaggtctgttataaataggaattggcatttcattgttaatgttttttcctcataaaaatagttacaccaaaagtgacatattgtctattacatgggcccaatcagtattaaagtactccccttactcaaaaatattaaaaaataattcatgacacttagtagcattttcattgattgtttcaaaagatcttcataatggtcaaattgtccaattcacaaaagagtgagaaagttgttttcagtactgggaatttttaaaccttagttttaagaccaaaaata

SEQ ID NO: 453899 - DNA, 1172 bp, Homo sapiens
  misc_feature (5)..(7): n is a, c, g, or t
  misc_feature (18)..(18): n is a, c, g, or t
  misc_feature (20)..(22): n is a, c, g, or t
tactnnncaaacatttcntnnnaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaaggtgggcactggcgtttttgttttgtctttgtgggttcctgttctggttaggaatctagctggccctggagttgttctgggaaatatctgcaaacactttccagtttgttgaatgatgagagctgttttcatgtaagctgtgtttggctttttccccctccaagtaataaaataccaaaaacttgtatttatc

SEQ ID NO: 453900 - DNA, 3213 bp, Homo sapiens
  misc_feature (5)..(7): n is a, c, g, or t
  misc_feature (18)..(18): n is a, c, g, or t
  misc_feature (20)..(22): n is a, c, g, or t
  misc_feature (1864)..(1865): n is a, c, g, or t
tactnnncaaacatttcntnnnaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattnntgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggacatgccattatgtctttccagtacggatcacagtgctgccatatcacagaccctgccagccggcacagaaccatgcctcgtcacagctctgcccaactcacaggctgccaagatgaggccacaggtccacctagggcggcagatgctggtgctatttgtcacgacttttgccaaaacatgtacactgttgctcacatctttcgtaagaatggttgacactaaggggccatggaaaagcacttttaaaaaattatgtggtggaatcaaactcacagaggcagaaatgttagtgccgtgctctaaccaagtaagcttagtgttccccacagtgatctgtatctggcctgagtctcctcaagcagcaacccccactgtccagcatgtggaaggtagatccttatgacaacaccagacccatagttaccaggaaagaaaaaggaagctgagtgttgtgaaggggaagaaatcctttttataagaagtaatcatttttaggccgggtgcagtggctcatgcctgtaatcccagcactttgggaggctgagacaggtggatcacttgaggtcaggagtttgagacctgcctggccaacatgatgaaaccctgtctctactaaaaatgcaaaaaaaaattagccaggcatggtggcatgtgcctgtagtcccaactactcaggaggctgaggcaggagaatcacttgaacctgggaggcagaggttgcaatgagctgagatcgcaacactgcactccagcctgggcgacagagcaagactccatctcaaaaac

SEQ ID NO: 453901 - DNA, 1494 bp, Homo sapiens
  misc_feature (5)..(7): n is a, c, g, or t
  misc_feature (18)..(18): n is a, c, g, or t
  misc_feature (20)..(22): n is a, c, g, or t
tactnnncaaacatttcntnnnaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaagagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagaggtaagttttgtttctttttaaaaagggaaaactgtagtaaagaatagaccttccccccttgaataaatgcactgtaatgttaccctttgaaagagctgaaatattctcctatgcctatgtttggagatgaagacttgggatgctggttttataatggcttggagagactgacgggcaggccagacaagaaggatggcaggacaagtagtcagctcaggaaaagaaactgagcaggaaagcagggtcaggaaaaatagagagggcaggggagaagagtgagaagagaaaaattccagcgtgggagcagtcagcagtcaggaagaccacatcagaaggaaatgaatcatgggttggaaaattcaggaaattagaacaggtgagtgtagggaatttgctccagcctgggagacagaaagaggaagtctccgtggggaaatttggatgctgagagcag

SEQ ID NO: 453902 - DNA, 200 bp, Homo sapiens
gtgtgggagagtaagggttggtaatctaatggaaaacgaagacatggaactattgggaaagtgagaacagtctggctagactagggacattatgagaacaaagctggatggtaacagaccttcaaggaggattcagaaagccaggtaaaagagcagcaggaaagaagccactacttatggttcttgaataagacagttat

SEQ ID NO: 453903 - DNA, 6031 bp, Homo sapiens
cgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctattcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctgga

SEQ ID NO: 453904 - DNA, 2552 bp, Homo sapiens
cgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgta

SEQ ID NO: 453905 - DNA, 4769 bp, Homo sapiens
taaataataatgccccaacctgggttggaagacataattttttgacatttgaatactgtttttctattttgtttgtatttgcagggaatattttatctttaaaaatcaagtgttttttttttttagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctattcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctgga

SEQ ID NO: 453906 - DNA, 1577 bp, Homo sapiens
cgaccaattgtttgaggcagtggaaatttataaaagcagaaaggaaagtatagaagaaggaaacttggagtgtcagaaacagaaaataatggaaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctgga

SEQ ID NO: 453907 - DNA, 187 bp, Homo sapiens
catacctccagataatctctctattcaagagtttcaaagaaatgaaaatattgatgtcgaggtaaggaggctatttaaaatgttttcctgtgaccatttttgaaaccaaatagtaaaaatgtttgaactatacagttgctgaaagaataaagtaataggttaagattaaaactgaaagcattaaaac

SEQ ID NO: 453908 - DNA, 140 bp, Homo sapiens
gcatccccttttattcttccatcttataccgaagcagttttgacaagtttacaggaagctgtacttacagctttagatgttctccaaaaggtaatataattttagtggctaagtaatactgcatatagttctctgaaatt

SEQ ID NO: 453909 - DNA, 423 bp, Homo sapiens
ttcatcattcaagggacaccgccgagaagcaatgggctgagacgtgggtattaacattggctggagtagcaaggatcttcaacactagaagatatttgctgcagcctttaggtatacgtacatttttttctgattatacaagtaattaatgttaaaagaaatttggaaaatacagacgattcttttagagtctatcttaacttagtctttatgtgtggtgtgtgtgtaagcatctgtgttttcattcgtttgtacctactgtgggctagcctctagaggatacaatgaaaggcaaaatacacgtcattcttgctatcatgggcatgaggaagtacccataattacataaataaaggcgaaatttctacaatgatgtgttacaaggagtggtactttgtgagcttcggtaagtatttgacctgg

SEQ ID NO: 453910 - DNA, 345 bp, Homo sapiens
ttttcactatatgtatgctattagctataggttgttctaggtgcctttcaccagattgaggaatttctctctattcctagtttgctaagcattgttatcattaaagctcattgatttaacttctattaaccatcaaaatttgttaattttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggt

SEQ ID NO: 453911 - DNA, 6201 bp, Homo sapiens
cgtcctgctgtcaggaagagtgcagggcaaactctgttttctacaattggtgcgcatggaactttattacagcattcaacctggcacactgttatctggaaggtactctttcatctactggacagagttcgagagtcctctaccactgcagacaaagaaaagattgagtctggaggtggcaatattctcattcatcattcaagggacaccgccgagaagcaatgggctgagacgtgggtattaacattggctggagtagcaaggatcttcaacactagaagatatttgctgcagcctttaggagatttttcaagagcttgggatgttcttcttgaccatatacagtcagcagcactcagcaaaaacaatgaagtatctctggctgctctgaaaagcttccaggaaattttacagattgtgtcccctgtcagagactcagataagcctgagacaccacctgtagttaatgtacctgtgcctgttcttatagggcccatatcaggcatgagcaggccatttgtaagaacagattccattggagaaaaactaggaagatatagtagctctgagccacccattgttactgatgagcttgaagatttgaatctatggtgggctgcgtggaatacctggtatagaattggatctgaaagtactaagcctcctattacttttgataaactaacttttattcctagccagccttttcttacagctttaattcagatatttccagctctctaccaacacataaaaactggtttcaatatggatgacttgcaaaagttgggagtcatattgcacagtgctatttcagtcccaataagttcagatgcatccccttttattcttccatcttataccgaagcagttttgacaagtttacaggaagctgtacttacagctttagatgttctccaaaaggccatttgtgtaggaccagaaaacatgcagataatgtatccagctatatttgaccagttgttggcatttgtagaattttcctgtaaacctccacagtatggacagctggaaacaaagcacattgcaaatgcaaaatataatcaggcggaatgggtagccttgaattatgtgccgtttgctgaaaggtctttagaagtagttgtggatttataccaaaaaacagcgtgtcacaaagcagtggtgaatgagaaagtgctccagaatattattaagactcttagggttcctctcagtttgaagtattcctgcccttctgaaagcacatggaaactagcagtatcctctctcctcagagttctttctattgggctacctgttgcccggcagcatgcttcttctggaaaatttgacagtatgtggccagaactagccaatacttttgaagattttctctttactaaaagcatacctccagataatctctctattcaagagtttcaaagaaatgaaaatattgatgtcgaggtagttcaacttatcagcaatgagatactaccttatgccaattttattcctaaggaatttgttggtcaaataatgacaatgcttaacaagggctcaatacattctcagtcatcttcatttacagaagcagagattgatattcgtttgagagaggaattttctaaaatgtgttttgaaacattactccagttttccttcagtaataaagtcacaacacctcaagaaggctacatctcacgaatggcactctcagtgcttttaaagaggtcccaagatgtactacatcgctatatagaggatgaaagattaagtggtaaatgccctcttccaaggcaacaagtaacagaaattatatttgttttaaaagcagtcagtactcttattgattcacttaagaaaactcagcctgagaatgttgatggaaatacctgggcacaagtaattgccttatacccaactttagtagaatgcatcacctgttcttcttcagaagtctgttctgcacttaaagaggcactagttccttttaaggatttcatgcagccaccagcatccagagttcaaaatggagaatcttgaccggctacaatatatttgaaagcaggaagatagtctaaaaaatgtttgctcctaattgagtcttctgtgagaaggacatttcttactgcaaataattcttggcagctgttgttggcctcctttaaattctacttacctgagttcagtaattcatattacaggcttgcacatcaacaaaggctcctgaatgaacagcagtgtaaggctttaataaattaaactgatgggagggataattaacactacagtatacatgctaccatatctccagttggtgatttaaagtgagcttatgtacagtttgtggtgtatgtgttaatgatgtactttttaaaaagaaagaagagatatttcaattcagtcagatttattagtctggtgtttttgcaccctttttcaagtacaaaatcgtactagaattttatgcaagatggtactgtaacattccatattatctataaccagcctttgttaacaaagggaactgatatacttgtgtgtataataaatggtacagttctgtataaaatagtgcatttatttaaattttaaaagtattgataatgttaaatgcttaaagctctatttattattaatacaaaattgtttgcttacatttttacttataatttgccttcatatgtggcggataagctcaccatatgatcatgcagttagcttcatgcttattttaaatgtattattagtgaccattaaacatctgaccagtaaggtcatgtgaacacagcagcaaatagtttatgatttgctgattttggagctttgaaatataggttcttaatacattgatacatattgtagcactatgacttcatcatacctcatttctttaaacagctctccaagctttcactgaagtctgtctgttttttatattggctgtctggattttaaagacttttcatattttatatttctactgattttgtttcccctaacaacatttgtcactgtctttgaattatgacccaggcaagatgatttcagattttctaaaatcttgcctgtgaggttttgttcatatcagtgcttcattttgtaatgtcttctcaagaaaaatacctatgttaactcacaagtataaaatatgtgtgtattataaaacaatgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttaaattttcataatttatgtgaagacacaaagatgtttaaaacaatgattattcataagaaatcatgatggtctcagtattattttagtgtattggaaggtctttgatcttaatagaatttataaatttcagcttctccagaataatcataaaactgcaaaaagatattataattgagtcatgattgagatacagttttgaggctattataattgtataattatttaatttgcattatctgtaaaatgtagtaaggtctttgaggggatattttttatttacatgaattactgaatttctattttattatttcacctaaaattaaggtaaaatatggcatttcataagttctgctttcagcattttccttaaagttgtaaaaaatcaagctatgtacttattttctatatttgggtgtgttaaattgaggattagaaaaatccacataatcactgataaagcattgaaacagaataacccaagggtagtgtaccgattcagtaacatgttaaaaatattgctatgcatttattcaaaggaaaatggtctattcttgagaaataaaagatcagttgcaattaggataattaaatagttaaatatgagtcaagtgtatgcaatatacatttatatgaaccaaagcttgctttatcaggaccatgccctacagttcaaaacataaacatagtgaatgtgttaatatcatataataaggtaataaatgccagtcttagtgtgaagcaagtgggtggcccccttggtagtataattggacaggattttcctccagaatatttcctgtcaccctccaagagtcactacagtaattgattgctggcatggaacacattgcccttgtcttgttagtatgaattgggttctccagtgactagaagaactggggtgtgtgaaagtattcgatgccaggagattcaaaaaggaagctctcaaagataagatcattttatggcacaattgagtctataaccagccctttaagcagtagtaaaaatgtcctttgtcatacttactagaaatactatgagttttttttttttttttcatttgagacggagtctcgctctgtcacccaggctggaatgcagtggcacgatcttggctcactgcaacctctgcttcccgggttcaagcagtttcctgcttcagacttccaagtagctgggattacagacatgccaccatgccaggctaatttttttaatatttttagtagagatggggtttcaccattttggccattctagtcttgaactcctgacctcaggtgatctgcccgccttggcctcccaaagtgctgacattacaggcctgagccactgcgcccagccaataccatgagttttaagcctcacatcgtcacttgctgtcactgccagtgcctgttttattcatattgctggacaacagacatatgccaccaattgtatgattaataaagtctttttctggccattttgtccattataaaggaaataaactaattgttaacttgcatagattacttcttagtttcctatgctaccaccactgccaagggagaaaaaaatacatcattttgtaatgtctttagtatttctttataactagtgttaaggttttgttaattttattgtatacatttgtaacatttattaggagccttttaggttccaaaacaaacaaaaggcataaaaaagtctagcttagaaccacttttcacttgctttcatttttaattttattcacttaacagctaacatctttcttgtttcttgttttttccattatatggttatcgattcaactcttgctatattccttaaatttgtatgtatcatcagaagaaagagatgaacaatttagtgtagatattttattctggagaataatattcaattaaattatttctacagcaggccagtaacaactagattatttgtcctttctcagtataattttaaagagcattttgttttattgtcacaatttggtaccactagtcccaggtaaccattgggccaaaggatcagttgagaaacagttaaggatgaattagcataagttatggaacagtgttagaaaacaactcaaaagtatattctttattaatgaggtggtcattattacatttgtgtcaatgaagggcagtgtagttattttaaaatgactaatattttctccccaaatacagaataattcagatgggcaaccaagttttcaagagactgctgtaggtgaagtctgtctagccaaggcagaacacttacaggagtccctaactgtgccacccttggaatgggttagtgtacaggctcagaatattgtggattacagtttttcagagaaaactaccacagatgtagacaaaaatgatctctgaaagcattgccagcagccaggtatgttccttagatttccacttaggtttggcattttggcagataagctaatcttgtataaagcatcacattttactatgcttagtgttcctgggttgtatttatctacattattagagggaatttttattttaaaaaaattgtcattcatgagaagaatgggagttcatgccacatagtattttaccaatttatataaagtgggaaaagtctttaatacttcatgatcacttgaattaaagtttttgtatctctggaaagtagaatagtgctttcatttgaatgaaaagtgtttatagattcagaaagagagatgatatctttgtatcttgatttatatacagaccatttcagaggaagttaaatgtcttacaaatccaatactttctaatgctctaacagtgttggctatttaaaagaacatgtgg

SEQ ID NO: 453912 - DNA, 2756 bp, Homo sapiens
tacatatggtcttttggcattacccaagtgagcctccctttctctgatatgccttgtagccaaagtattaaaggctgatgaacatagacaagggaaatgcatttcttagaaatccgtgaacctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgtttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacaaaaaaaaaaagaagtggggcaaattctgggggggaaaagaggtagaatgggtg

SEQ ID NO: 453913 - DNA, 2703 bp, Homo sapiens
tacatatggtcttttggcattacccaagtgagcctccctttctctgatatgccttgtagccaaagtattaaaggctgatgaacatagacaagggaaatgcatttcttagaaatccgtgaacctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgtttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtaca

SEQ ID NO: 453914 - DNA, 3598 bp, Homo sapiens
tacatatggtcttttggcattacccaagtgagcctccctttctctgatatgccttgtagccaaagtattaaaggctgatgaacatagacaagggaaatgcatttcttagaaatccgtgaacctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgtttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacaaaaaaaaaaaaaaaaaaaaaaaaaaaaaaaaaaaaaaaaaaaaaaaaaaaaaaaaaaaaaaaaaaaaaaagaagaaaagaaagggtggtaaggggcgatccgatggaataatcatgtagaggatagtaagtcacatggaaggatcactaataaaaagcaaccatctaacttgaataaaccgtcgccaacgtcgctggagcctatagaagactaagaaacaatgtagacaacgggagtggtggcgaaaatttctggaacaccacaacaccagaaagatttaaccgcctagctaagtaaagatattaaaatatcaacacggaaatttaaaattagcaaaacaatacaccatatatagatagaagagaatgaagaaaaaaaatgaatagccaaacaaaacaactccgaacaacaagtaaacaacaaggaccatcgaccagacaaaacacgaaacaacgaagaacacaacaacaacacaacagcgtaacaaaatcacacaacagaacacgcaaaaacacaacacacgccaccagaccaaacatgcaaaaacagcaagaagaacgaacaagcaaaaaaaaaagcaagaacacaagagcacaacacagcacaccacaaacacaacacagaccacacaacacgagaacaacaaccacacaggcagaaaacaacaaaacaagaaagccacacagccccacaacaccaagaagaacaacaaacgacgaagacaacacacacaccacaccacagaccacacaagagcaccagggccaagcacgagaggaacgaaccaagcacacccactacaaccaacacaaccagagagcaaacagacacaaacacagaacaagaccagcagcagcgacacaaagagcacgaagcaaacaaaaacacccacgag

SEQ ID NO: 453915 - DNA, 3057 bp, Homo sapiens
tacatatggtcttttggcattacccaagtgagcctccctttctctgatatgccttgtagccaaagtattaaaggctgatgaacatagacaagggaaatgcatttcttagaaatccgtgaacctcagttgtatgctttcagtactcgtgttaatatgtttctatggcaactctgaggtcagtggtttagaaatgagataccagtgttaatgaaaagtgtgtgctctttgcttttgcatggcttggcttagtatccaaggtatattagggccacttgaaagcatgaagaccagttatatagggaacaggtttctctcagtggcacattttgctttttctgagccccaaatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgtttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaaaaaaaaaaaaaaaaaaaaaaaaatctttgtggggcaggcttagggccttgagaaaaggttttttagagaccatttgcgtgttgggggcgcggggggccaagtgtggtgtaaggtggacatgtggggccaatagcggtgtttcccagaaggaagaaccgcggggcacagtgaccagagaggccgggggattctctcaccccatataaaaaaacggcccgggggggaaaacaccgagaggaggttctgtgaaacaaatattccagaagtgggaagttctagggaagggacaaatagagagggaaactcatattcaacacggggggagttcaaagaggagaagctccaaaatttcaaatttagccaggatagtggggtgtgaagc

SEQ ID NO: 453916 - DNA, 1206 bp, Homo sapiens
gcggacgcgcgacagaagatactgacaatatacgtacaataagccttacagttagtgctgggaccatttataccaaaaggaaaatgcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtacaaaaaaaaaaaaaaaaaaaaaaaaaaaaaaaaaaaaaaaaaaaaaaaaaaaaaaaaaaaaaaaaaaaaaaagaagaaaagaaagggtggtaaggggcgatccgatggaataatcatgtagaggatagtaagtcacatggaaggatcactaataaaaagcaaccatctaacttgaataaaccgtcgccaacgtcgctggagcctatagaagactaagaaacaatgtagacaacgggagtggtggcgaaaatttctggaacaccacaacaccagaaagatttaaccgcctagctaagtaaagatattaaaatatcaacacggaaatttaaaattagcaaaacaatacaccatatatagatagaagagaatgaagaaaaaaaatgaatagccaaacaaaacaactccgaacaacaagtaaacaacaaggaccatcgaccagacaaaacacgaaacaacgaagaacacaacaacaacacaacagcgtaacaaaatcacacaacagaacacgcaaaaacacaacacacgccaccagaccaaacatgcaaaaacagcaagaagaacgaacaagcaaaaaaaaaagcaagaacacaagagcacaacacagcacaccacaaacacaacacagaccacacaacacgagaacaacaaccacacaggcagaaaacaacaaaacaagaaagccacacagccccacaacaccaagaagaacaacaaacgacgaagacaacacacacaccacaccacagaccacacaagagcaccagggccaagcacgagaggaacgaaccaagcacacccactacaaccaacacaaccagagagcaaacagacacaaacacagaacaagaccagcagcagcgacacaaagagcacgaagcaaacaaaaacacccacgag

SEQ ID NO: 453917 - DNA, 1545 bp, Homo sapiens
tgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagata

SEQ ID NO: 453918 - DNA, 1492 bp, Homo sapiens
tgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagata

SEQ ID NO: 453919 - DNA, 1609 bp, Homo sapiens
tgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagcatttaagttctgaatttattggtcaaaatagattttggaaaacttgaaaccttttggaac

SEQ ID NO: 453920 - DNA, 1516 bp, Homo sapiens
tgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactattgtatgaaatacctgtttttcagaaaataaaggttcagtctcaaaagata

SEQ ID NO: 453921 - DNA, 3537 bp, Homo sapiens
tcaattttcctttttccggaggggagatggattccctggaatggaactgggctctggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcgtgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctctctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcccgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaagctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgcctttg

SEQ ID NO: 453922 - DNA, 938 bp, Homo sapiens
cgccttcctgggggaggggggggggggggggggggggcgggggggtgggggcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaagctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgcctttg

SEQ ID NO: 453923 - DNA, 3519 bp, Homo sapiens
cagagacaatgcccaaggccgtagaggacctgaacaaggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcgtgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctctctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcccgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaagctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgcctttg

SEQ ID NO: 453924 - DNA, 2008 bp, Homo sapiens
aaaaataaggatattggccgggtgtggtggctcactttaatttatatatttaatagtactgtcaagatgttatcactcgctaggtgaccgcagacagtcttgtggcctcccttctcccctgccatccccatcacacctttcttttttttttttttttttttttttttgagatgggtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaagctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgcctttg

SEQ ID NO: 453925 - DNA, 1382 bp, Homo sapiens
gagtttctggagctgttccgagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctcggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcgtgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgattcggccccatgccattcggatggattctgcgatgacagtcaccgggcac

SEQ ID NO: 453926 - DNA, 3923 bp, Homo sapiens
ttgggaaacccctacctgtctgtacctgtaggtcttttctctggggtctggaagaagaatccttcaatatcttgccttctggtaatctgagagcagggcgagaaaaggaagatcagagttccacccttaaatctgtaggttttcactcccccactctcctttgcagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctcggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcgtgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctctctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcccgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattg

SEQ ID NO: 453927 - DNA, 4302 bp, Homo sapiens
gagtttctggagctgttccgagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctcggggggcggctggtgctgaacaccaaggaggagctggccaatgagaggctcatgacgctcaaaatcgctgagatgaaggaggccatgaggaccctgatattcccacccagcatgcactttttccaggccaagcatctcattgagagaagtcaagtgtttaatattctaaggatgatgccaaaaggggctgccttgcacctccatgacattggcatcgtgactatggactggctggtgaggaatgtcacctacaggcctcactgccacatctgtttcaccccaagggggatcatgcagttcagatttgctcacccaactccccgtccatcagaaaaatgttccaagtggattctgctggaggattatcggaagcgggtgcagaacgtcactgagtttgatgacagcttgctgaggaatttcactctggtgacccagcacccggaggtgatttacacaaaccaaaatgttgtctggtcgaaatttgaaaccatcttcttcaccatctctggtctcatccattacgcaccagtgttcagagactatgtcttccggagcatgcaggagttctacgaggacaacgtgctctacatggagatcagagccaggctgctgccggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcgtgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctctctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcccgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaagctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgcctttg

SEQ ID NO: 453928 - DNA, 1030 bp, Homo sapiens
acggaagaaaaaaatagtgagttcggggagggtacgacccctcgtctccccccccccacaccccatccgatttaatctggatccattccggcgccttcctctcccagtcacccagagggccccaaccccggcggccctttcttcctcaaatgtcctcggctctataccgtgcctgggtcttttctctttctctctgcctggaacattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaaaaaaaagctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgcctttg

SEQ ID NO: 453929 - DNA, 539 bp, Homo sapiens
aagaaagaaaaatgttaaataaaaatttaaaaagtaatatgttaattccaagaagtaaaccatagaaaagactggatgcatagcactggttagaaataaaaatccagtgagagtttcagaactcagccatgcccctgtgattgtgtgccagcctttggaatggaaagcccacccagtctcccagttatcatctattcgagagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcacta

SEQ ID NO: 453930 - DNA, 1165 bp, Homo sapiens
aggacttatactgtgttaattttctattgatgccataacaaattaccacagagttggtggcgtaaacaacacacatttattattgtatagtgctgtaggttggaggtctgacacaggactcagtgggcagaaatcaggctttcagtaggctgtgtttcctgttgtgggctctaggggagaatctattttcttgccttttccttgcttctagaagttgctcacattccttggcttcaggcccttcctccatctttaaagccagcagtggtagatggagttctcacatcttctctctctggctctcctgcctccctttttaggatccttgtgattatgttgggtccacctggaaaatctgggctcatctctctaccttgaagccagcagattagcagctttaattccatctgcagccttaattcccatttgctatatgaggtaatatattcacaggttatggggaaatgttctaagtattgagtcatcttgtttgaattttgtggggtactgaagttcaggaaaactgttctctccagaagtcaccagaggcttgctttcagtatagggaagtcttagtttttgctgcctcacagatgtaataaatattgcaaacctcactcacagagggtctacccttgggattctggagcagcacaaaacctacaaggagttgagagaaattgtgtctataggtgaagcaggttcttagcatcaggaagggaaaggaggcgaaggcgtgatgacctgacaggtgtgtggaaggagctcagcagaagcaagagggagagaagacacactgaggtgagaagtaaaaaagggtgagaatagagtggtgggcattgtggcttgagagccccaggcaccagtggaagacaccgaaaggaggactgctcatacctggggtgggctgggtgcagtaaagtcattccctgtaccgtgccttggaagctctgaggggtcgtggctcaggtattctgtctctaagcctgagctcctgtagcacatgatgacctcatacggaaggagacttttatctcagcatccctcaacctggcacagcagttattaaactttttggtcacaggacaccatgtatagtgttaaaaattattgaaactctcatacactgctggtataaaatggtgcagccactgaggaaaacagt

SEQ ID NO: 453931 - DNA, 807 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagggtattaaaaaccagtgacatgtagcatgaaggcggatgaggcccatattgctaatgtgatgcagatgtggacgttcattgtggctttggtttttacccacaaaggctatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgctgtgtcgcctctggcaatatattatcaacatccaaaaaacagggaacccagatggacggatgctcctagatatctttggcttgaaaatcttcacccctcttttcgaaattccgaagtggccaccagattatgc

SEQ ID NO: 453932 - DNA, 333 bp, Homo sapiens
  misc_feature (31)..(31): n is a, c, g, or t
ctctcgaggatccccggcaaggatctgtggncaggagtagatgtatttttacttcctgagaagtgctttccttctgctactgtatttgcaatattacaatgttcacttttagggtatggaagatagtaacctaaatcctgttcctctcttctgttgagcactgtatacacagaagcttcccaaggaaaagctatgaactctacactttggaggaggttgaggcagtgggggtgagaggtacgagtctttcctaagctgactttactgttttttgcctgatctcctgcatacctgatgtccccatgttttcctctaagtgccccagagccctcc

SEQ ID NO: 453933 - DNA, 4078 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453934 - DNA, 4098 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453935 - DNA, 4161 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaaggtgaccccagtggctgaaagcaggagaaagtgtttcatcacgggccctctccttctgaatactatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453936 - DNA, 4282 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagagggtattaaaaaccagtgacatgtagcatgaaggcggatgaggcccatattgctaatgtgatgcagatgtggacgttcattgtggctttggtttttacccacaaaggctcacagggaatctactagagggccctgcctccacttccatcaaacaagggaagaaaatgctcttcatgaggtcactgttaactgagccagcatagggaggctcagcagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453937 - DNA, 3860 bp, Homo sapiens
atgcaagtcacttctattttggatgcctctgattatagaccttctgactgttgaaggctgactaggaaatactctgcatgggagttctatgtaatatagctatatgtttcaaaactatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453938 - DNA, 4383 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagcactgtatacacagaagcttcccaaggaaaagctatgaactctacactttggaggaggttgaggcagtgggggtgagagaaggtgactcagggagttgtgcaaatgactgactcatatttcatggatacgagtatggctgatgtaagactgcagttatctcctcctgattcaattaagcacagggaatctactagagggccctgcctccacttccatcaaacaagggaagaaaatgctcttcatgaggtcactgttaactgagccagcatagggaggctcagcagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453939 - DNA, 4347 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagcactgtatacacagaagcttcccaaggaaaagctatgaactctacactttggaggaggttgaggcagtgggggtgagagaaggtgactcagggagttgtgcaaatgactgactcatatttcatggatacgagtatggctgatgtaagactgcagttatctcctcctgattcaattaagcacagggaatctactagagggccctgcctccacttccatcaaacaagggaagaaaatgctcttcatgaggtcactgttaactgagccagcatagggaggctcagcagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453940 - DNA, 3979 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453941 - DNA, 3875 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcatggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453942 - DNA, 3176 bp, Homo sapiens
caaatgttgtgaaaccttcgcaagcacagatgtgaggtagaatctggctttccctgagagcatgagccccctctcagcctgtgctgtggtccctggtccccctcgtcaccagctatggctctagtggctgcttcagtgctaatgagacaagccggagctcctggcagctacacagctctgcaggaaagccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453943 - DNA, 2867 bp, Homo sapiens
cagcaactcccatgggcccaagggattataggcaggcttggagctcagaacttgacaggggacatatgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453944 - DNA, 2694 bp, Homo sapiens
ttggatgtatcatgccggacactatctctcggttaacctgcaggacccgaagcgccactccatgcgccacccaaagagccacgcaacgagcccgggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453945 - DNA, 1779 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcacta

SEQ ID NO: 453946 - DNA, 1842 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactaaaaaaaataacttaatgttacatacttgtgttctccttttatcttattgtcaatttattatga

SEQ ID NO: 453947 - DNA, 1777 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtcagaacataagggtgggtcagaacataagagtgggtcagaacataagggtgggtcagaacataagagtgggtcagaacataagagtgagtcagaacataagggtgggtcagaacatgag

SEQ ID NO: 453948 - DNA, 1576 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcatggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcacta

SEQ ID NO: 453949 - DNA, 1200 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgagggtaagatggtttaaaacagcgttttgtggtgcagtgttgccaatacatcatctgagtaccagagatgcatgtggtcacattgatcatttcccccactacatgatgtaaaa

SEQ ID NO: 453950 - DNA, 700 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagggtattaaaaaccagtgacatgtagcatgaaggcggatgaggcccatattgctaatgtgatgcagatgtggacgttcattgtggctttggtttttacccacaaaggctatttgaacatggaattcaatccttcagatcatcctcgggccagcacaatattcctcagtaaatctcagacagacgtgagagaaaaacgcaagagtctcttcattaaccatgtaagtgaagctgtctccctgtgttcttcataatgactgtacagtgtaaagagctaaaataactgtctgtgatggatgaaaatggctcatgtgctttgtagatacttggaagaatgttgcagtgtact

SEQ ID NO: 453951 - DNA, 324 bp, Homo sapiens
cccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatcta

SEQ ID NO: 453952 - DNA, 1727 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggaaccacgtgattgaatgtgccccggtggcagtgttggagacttgctccggcgcggggagggaaggcagtgcggatatggcccaggagatgtttcccagggcacctaagtgttttctaaaaaaaaagggtgttcggacacatgtataaaaggattggctcgtcaatattcc

SEQ ID NO: 453953 - DNA, 4067 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453954 - DNA, 3966 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaacacattgtcttagtgtagtttttgaatggaaagtttttgtcattaaggatgaaggaaacgacacaatttgttactttaattttatatttgatttaaacaacaaataaagtcattgggacaataaatatatatccc

SEQ ID NO: 453955 - DNA, 4141 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacggtgaccccagtggctgaaagcaggagaaagtgtttcatcacgggccctctccttctgaatactatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453956 - DNA, 4197 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaagaaggtgactcagggagttgtgcaaatgactgactcatatttcatggatacgagtatggctgatgtaagactgcagttatctcctcctgattcaattaagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453957 - DNA, 4323 bp, Homo sapiens
tgggagcggaggagagatgtgagcctcgtaccaggaagatcatactgaggccaccaggttgagagccgcctggctggggggcttgtccggggacagcaggggcagaggcatggaggttcacagccaggaaatcgtgcagtgaacctgtcccctccggtcacaacatcaagagctgaactgggactagaagtcatcgccccagagctttttgctaccagaactgccgggtgaaaatctttggaagagaagtttgagaacctgttaaacaagctctctaggtaattctgtgcacgttcagtctgagaactgctgcatctgaagaggccctccagaaaaaggaagaaaagtgggaaggatccttgtgattatgttgggtccacctggaaaatctgggctcatctctctaccttgaagccagcagattagcagctttaattccatctgcagccttaattcccatttgctatatgagcacagggaatctactagagggccctgcctccacttccatcaaacaagggaagaaaatgctcttcatgaggtcactgttaactgagccagcatagggaggctcagcagatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453958 - DNA, 3547 bp, Homo sapiens
tgacattcttgcagaaagtaagtttcattttctattattttccctaccagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453959 - DNA, 4024 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaacattgcctgctctcaatgaaacatgctttggaaatggaagggactcagaaagtcgaaatcccaagaactccaagccaaaagtgttaggttttagtgaaatttgtgtcaggtataagcatacctgtttgggccagaattattatcacagcctttctgacccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453960 - DNA, 3915 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatctaaaagaaaaagaaaaaaaacaagggtgggttgggtattccagtgggaagatcattgaagggaaaaatgttactatttactgaggtatttttcacagaatgattgaattaaaaaaaactcaacttgcattttcattgtgggtgcttagagaagttctacaaaattcaaactgtgaaggtttatgcttcattaattatgaccatactttttcattttctgacgatccctgatttccttatggactcaataagaatcttttatatcaagtaaaatgaaagttgatgatagaatatcaaatagtgaatttgatatgaaatctaagagtgtgagtcacttgcatatgtaatgctttgggtttttgcatattttcttaggtcacagtgacaggtttctgagttgtttcccttttcaagtctctgggaggccagtggcagcagcaggtctgtgtttcaccttcttcccatgtgagcttggaaaactttggcatcttaattagtcttgaatcatacacctgatccccaaactttcaaaagcaaataaacagcatataaaacgttaattatctttccattgtaattgtgatgatctactctgtatgggtaccaaaatcaccttctctcttcaagtcaaagttgaatttagaactttgaatacaggtcaaaaaatgtagaaaatatcattttatattccctaatctatatagctgaaaaagggttgtattttcttagctgaatatgaatacctcttaaacataaattagttcctctccagtgaagtatcttattttaccaatccatttcaggaaagaggttctgctgccgtaaaggcagaaattttatttttatcccttttatttgaatgagagatttgaaaatcgaattatgtaaatatttcaatgcatctgctattattttgtggagtttattaaactactttaaaaaaattgtatagtctatttattgtatgtatgtacatacagtctgatacctaaaatttaaagtggattccataaaaccagactcaagtcttgtttagactactgaatactgttttagcctgtgccctggattctacctctgtataggaaaattttccatattcattaattagtgttgatctgtattaattggttatgtttcttgcactaaggatgtttaaaactccgctgtaagtgtagattttagttttactggcaggatgaatcacttgacacataggtagatacttgaggttcattttcttttctttttctacatgatgatgaatagttatgttttcttctctgatttgttcaaagtttgccaaaagaaaacacaaaaccagtacagtacttactgataaatcgtagtgactgtaatttgtttgtaaggcgaattaatgctctacaattaaagctggattactattgaggaaaaaaaaaaaaaaaaaaaaaaaaagaaaaagaaacaaaaacaacacaaaaccaaacacgacaccacgaagaagaaaaaaaaaaaaagaaaaaagaaacgaggacaacagggaagaacagaagaagaagcgatgcactcacaccacgataagaagatgaacagggcggcagcgacatgacgccggtgccgaacggcaagcaccccagcagcggccccagacgatgcaggagcacagagggcgaacatga

SEQ ID NO: 453961 - DNA, 2256 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcagtgccctggagatcccagctcgctctccccactgtcagcaacagcacttccttcgtggaggaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcactatttctgcgcgctgtcttctgagctttcttcctcaccagtgggctgtgcttgttccatttctgtacacccttattttataccgtttttcttcaacaatggcgaaattgactgtagtgctgaaccaaaagtatccctttccctccttattcctcaccccaagaacattctagatcacatgggtgcttgtgccttccgattttcttgcatttgtttttttcctgacctgaagttgttgttacaaaatcagtcagactttgtgggctgaaggacacggtgcagcagagggtgtccctgtgagagttctgcagagtgctgggcatgtgcctggaactaccgagtaggagccatttctttgtacccctgcctaatccattcctctccttccaagtccattgttgcaagcaatattcttctcaatttttatatgtttactttaaatcaaagttagtctatttgtataaaatttttaaaaaatct

SEQ ID NO: 453962 - DNA, 1717 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagtttctcctttagtttgagaaaagacagacttggggtgggtttgtttttgttttttctttccttttctttttttacgcatagctccgtcaagctgcctggatgagcgcccatgcagcaaggcttggaggaagcgtcaagtggactcgaatcctggaggaggaaataaagggaaagggaagtcgtggagaggcagggaaaatggttaagcagcccggccctctggagtccccatgggggcggtagctgaagttggcgagcgcagcggtggatgcagagctggctgcacccagggctgggccagtgtgtcctgtaagacttcttgcattccttctgctgcttttttgggatgggggtatttttgttcatttgtttttgccctgttttgattttggtcccacagagcaggggatgtagtttgtacccaccatggcgcagacttccaaataaatagtactggtcatttctctctgcacta

SEQ ID NO: 453963 - DNA, 1302 bp, Homo sapiens
aggccccgccgccgccgccgctgctgacccggcggccggccgccgttccgccccctcccgtggcggcgagcgggcgggcctccccacacgcccccgccgcccgcgccccgcgtccacccgcgccccgctcccggggactgggagaacaggatagcagcaggagtcggggggccgccgaagatggggaacactacctcgtgctgcgtgtcgtccagtcccaagctccggaggaatgcccactcccggctggagtcctaccggccagacacggacctgagccgcgaggacacgggctgcaacctgcagcacatcagcgaccgggagaacatagacgatttgaacatggaattcaatccttcagatcatcctcgggccagcacaatattcctcagtaaatctcagacagacgtgagagaaaaacgcaagagtctcttcattaaccatcatcctccaggacaaatagcaaggaaatacagttcctgctccaccattttcctagatgatagcacagtcagtcaaccaaacctcaagtatacaattaaatgtgtcgctcttgcaatatattatcacatcaaaaacagggacccagatggaaggatgctcttagatatttttgatgaaaatcttcaccctctttcgaaatccgaagtgccaccagattatgacaaacacaacccagagcagaagcagatttaccggttcgttcggacactgttcagtgctgctcagctgacggctgaatgtgccatcgtcaccctggtgtaccttgaaagacttttaacatacgcagagatagatatctgtccggccaactggaagcggattgttttaggggcgatcctgctggcctccaaggtgtgggatgaccaggctgtatggaatgtggattactgccagatcctgaaagacatcacggtggaggacatgaacgagctagagcgacagtttcttgaattgctgcagttcaacatcaatgttccttccagtgtctatgccaagtattattttgatcttcgttctctggcagaagcgaacaacctgagctttcccttggagcccctgagcagggagagggctcacaagcttgaggccatctctcgcctctgcgaggacaagtacaaggacctaagaagatccgcgaggaagcgctcagccagtgcagacaacctgactctgccccggtggtccccagccatcatctcttaactacggaggccgcctggaaggctcaacaaatggtaattacaaatgttgtttactactctcaatagacggccagggataccgtatgtcatgcgtcta

SEQ ID NO: 453964 - DNA, 400 bp, Homo sapiens
actgtactgttatttcacatcctgagagtcttttctcagactgtaagctcttgggaaacaagagctgagtccacactcccttcgtatctccctgctgccagcagagagctgggctctgggccggagctccacaggggcaggggctctgcctgtccctcatgcagcgccctcggcgcccaggacgagtgagcaatggacgcagatatggcccgccctgacccacactgtctttcttgcccctcaggccatctctcgcctctgcgaggacaagtacaaggacctaagaagatccgcgaggaagcgctcagccagtgcagacaacctgactctgccccggtggtccccagccatcatctcttaactacggaggcccgccggaggccacaccatcccttagttt

SEQ ID NO: 453965 - DNA, 1740 bp, Homo sapiens
tctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaagaa

SEQ ID NO: 453966 - DNA, 1616 bp, Homo sapiens
aacaaggacatgtgactctcccacctcgttgcgtggcagagccaaagagctgagcaaaaggagctgctgcagcttgaagaaaaagccacccctgaaggctcctgccagagccaggcttaccttctctccctcgagaatcttctcccgaaggaccagcccagggaagggaagcagctgctctggactcactcaagtgtgtctcacaccccttcctcttccagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaagaa

SEQ ID NO: 453967 - DNA, 1167 bp, Homo sapiens
tctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaagaa

SEQ ID NO: 453968 - DNA, 327 bp, Homo sapiens
tgagatggggtttcacttttgttgcctgggtggagtgcaatgacacgatcttggctcactgcagcctcagcctcctgagtagctgagattacaggcatgggccaccacgcccagttgatttttgtatttttagtagagatggggtttcaccatgttggccaggctggtctcgaactcctgacctcaggcaatcttcccccttcggcctccaaaagtgctggaattaccgccgtgagccaccatgcccggccccatgtcaccctttccccagcctcctccaagctgccacaagcagtctcaaagctctctctgtgtctctcctctcag

SEQ ID NO: 453969 - DNA, 864 bp, Homo sapiens
tctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgaggggcaggggaaagaggacaaggccaagaacaggggagggcctgaataccaagtggagaaagag

SEQ ID NO: 453970 - DNA, 1951 bp, Homo sapiens
tctgagaacacacgcatgcattccaggcggtgctgctggggctcggcggggccgtgtctggtctgcaaggcgcgcgggctcgtggggggttggctggggagcccacgctgcctggcgactcgggccaccgaatgtgagaccgagtccctttatgtcaccagcgcacacgctgatttgaaccctgcttcgacgtgtgtgtcatggcttaaaaatagctgctaatctgtcaacctgtcttgggcagaaacagcggcggcgacagcagcaggagcgtcatggccgtggcgctgtctgcgccggcgatccgcctttcggactgaggcccagcgcagcgcttgcaaagagcagcagctacctggcaactgaacccatcatcaccacagccactcctgcagctgccacggtttctgccacctctaagatgtgccctggtaactggctttgggcttctatgacttttatggcccgcttctcccggagtagctcaaggtctcctgttcgaactcgagggaccctggaggagatgccaaccgttcaacatcctttcctcaatgtcttcgagttggagcggctcctctacacaggcaagacagcctgtaaccatgccgacgaggtctggccaggcctctatctcggagaccaggacatggctaacaaccgccgggagcttcgccgcctgggcatcacgcacgtcctcaatgcctcacacagccggtggcgaggcacgcccgaggcctatgaggggctgggcatccgctacctgggtgttgaggcccacgactcgccagcctttgacatgagcatccacttccagacggctgccgacttcatccaccgggcgctgagccagccaggagggaagatcctggtgcattgtgctgtgggcgtgagccgatccgccaccctggtactggcctacctcatgctgtaccaccaccttaccctcgtggaggccatcaagaaagtcaaagaccaccgaggcatcatccccaaccggggcttcctgaggcagctcctggccctggaccgcaggctgcggcagggtctggaagcatgaggggagggggagagaggtcaggccaggcccgtgggtaggtccctggctcccagctggagataggaggcccaggtggcaggtagcaggaggcccagatcacccatcctcccctggggtcaggagaggccgagccccaggccactgtcactctttgtgggaggggacggggagtgaggttgggcagtgtggtggatgggcacccaggaagggttgaccagggaaggaggcagctaggctgtagatggaagatggtcctgggattcgaacaccgctgggatctggccagggtgctccctgggattcacagtcccttcccctctttgtgcccaagtgtttccctctctccctcaccaaaacaaaagggccatctctgccctgcacttgtgcagaaagtcagggatacggcaagcatgaatgcaatggtgtagagttgtgtgaaacccctagcatagagacagacagcgaagagatggtgtgaaaagcttgcagaaccagacagagaaccccacagactttccactccaagcacaggaggaggtagctagcgtgtgagggttggcactaggcccacggctgctgcttgggccaaaaacatacagaggtgcatggctggcagtcttgaaattgtcactcgcttactggatccaagcgtctcgaggataaataaagatcatgaaaaagaaaaaaaaaaaaaaaaattgtggggacgccgagaccagaaaagtttaaaaaccttcgggtgggggccgggcccacagaggtagagaaaagggcaggggccaaagaaaccggcacgaaaaagggggggttcccacaaaaaacggcggggaacgacgtcgaaaaaccaagggcggggcaagggctcaaaggggccggagcgataccaacgggagg

SEQ ID NO: 453971 - DNA, 765 bp, Homo sapiens
aataactacacaaaatctcaccaaaagaacatttaaaataggagtttcgtatataaactatgcctcaaagtcaacttgataaatatagtcactgataaaaaaatcaaataatagtaaccaattttaatttaaatacaaaatggatatggttgcagattctacattgcaactaacccttaagaaactatcatttgttgaattttagtatagtatcataaaaggatagtcactctatttatatggaaagtccagaataggcaaatccatagagacaaagtagattagtggttgtcaggcactggggagaggaaaggaatggagagtgactttactgggtatttaggtatccaccttccaaaaaaatcataggttttcttcttgtggtaatgaaatgttctagaatttgatactggtgatgactgcacaaccaatattgaaaaccattgactagtaactacacttttaatgagtgaattttatggtatgtgagttttatctcaataaaaaaattacacagaaaagctagatttttcgtatactttgaaataatgtgtcacaacagattgtatgcagaaatagatatgaaaatcctgctgtcttctagtacgctatgttagagatttgcaaatgtaaaacattgccattcttctactaaatgttttttgttatggcttaaaaaaaatttggttactttttataaaagtgctatttatgttaaacacataatgggtttattatttttaatgaattaaatattttttgaaa

SEQ ID NO: 453972 - DNA, 531 bp, Homo sapiens
gcggccgcggcagagggcagcccggggcggcgccggctggccggggaggggcggggggcctggccccggggcggtggtgcgggatgccgccgcctccgggccgcgtccgttctccaccttccaaaaaaatcataggttttcttcttgtggtaatgaaatgttctagaatttgatactggtgatgactgcacaaccaatattgaaaaccattgactagtaactacacttttaatgagtgaattttatggtatgtgagttttatctcaataaaaaaattacacagaaaagctagatttttcgtatactttgaaataatgtgtcacaacagattgtatgcagaaatagatatgaaaatcctgctgtcttctagtacgctatgttagagatttgcaaatgtaaaacattgccattcttctactaaatgttttttgttatggcttaaaaaaaatttggttactttttataaaagtgctatttatgttaaacacataatgggtttattatttttaatgaattaaatattttttgaaa

SEQ ID NO: 453973 - DNA, 6283 bp, Homo sapiens
gattccccaacaacgacctccggtccttccccttccccgcgagacctccgccccagctccgccccgcccggggctcttgcgtttcggagtcccaactacgcggagcgggcgccgcggccggagcgtccctccacacgtcctcccccagccgccagctccgccgcggggccagaccgggcccgggacgccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctgttttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaacta

SEQ ID NO: 453974 - DNA, 4538 bp, Homo sapiens
gattccccaacaacgacctccggtccttccccttccccgcgagacctccgccccagctccgccccgcccggggctcttgcgtttcggagtcccaactacgcggagcgggcgccgcggccggagcgtccctccacacgtcctcccccagccgccagctccgccgcggggccagaccgggcccgggacgccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagatcacttcacaagaagaggactcctcctattggccagaaaaagtccctttatgattttcaggtgcaatcagttgtccaattcctctaggtcggtctttcgtctagc

SEQ ID NO: 453975 - DNA, 6238 bp, Homo sapiens
gattccccaacaacgacctccggtccttccccttccccgcgagacctccgccccagctccgccccgcccggggctcttgcgtttcggagtcccaactacgcggagcgggcgccgcggccggagcgtccctccacacgtcctcccccagccgccagctccgccgcggggccagaccgggcccgggacgccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctgttttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaacta

SEQ ID NO: 453976 - DNA, 4620 bp, Homo sapiens
tctatagaaaaatgcttgtttctatcaagaatgactcctttataaactggggagtatctttaagagtggtttcaaccctgactgtatagtatcatctgttgaggagcttaaaaaaaatatgtaggcccagcccacactagactggcattggtacctggtatcagtattttttaaaaacttcccataggattctaatgtacagccaagattgaggaccatttgtctgtcatctgggattatgcttaataaattaatactgttttttaaattaattagatttcacttctaagtcattatcagtaaatttactcagtatctaactgacaagaatttctagcatatatttcttgattagtgcatgtaaaattctaaaagaatttctatagtattttccaggcaataagacaactagtgccccaaatttaccaaatgcatgagtctaagcctgtgctatatataaatatactcaaagccaagtttacatctgtgtacacaagtgtgcatgcatatgtacaattaaagactatagttgtaacagtcatgagcttgtgttttgattttactcctattcctgtattgtattaagtgtactatcatgttcttgaggcatatctccaggagatatgtttatttcttttccaggaaaagtgggacatatataagtagggtaaacgctagagctagatactcctttaatctctattacgtcagatctctggctcccttttacaaccaggcaatcttcaattataggtggctaatagggaagaaaatcatcggcagagcaacagcttcatgtaatttcagagtagaaaaatgaattttaatcttctgaaaggtaatattagaattagctggattgctacacttaggaatcataggttccaaataaatatcagtacatacggaaatcagataatgggacagattatttgaaattagggctgcctagaaatctggaatgtgagatcaccctccttctgaccaaatatgcttgaataaacttaatattccaaattatgtgagggattgcctattgtgcaaaaaaaaaaaaacgaaatctgaatttaaaaaaaattaccacagtctagtattattttagtctcttggatgttataacgttatctgttccatctgttgttaatatgagacactgtacaaacaaacaactatattgatttagaatcagtatagatcacctagctttttgtctcaattttcctactttaatgctcttggggctttcgcttttgattttcagttttttccttaaaataattaatattgttgaaattagactttctaaatttaaatttatcagaatttcctatgtaaaatgagtctaggcaccaaatgtttaatgactttaaaaaaaatgtttatgactataaaaggaaaaaccctgtatcaatttcaagcttgttttatatccaaagtgctagttattttgtgatgagaatatatgccccaagaacatttttgaaagacatataattagtaacttttttatttttcaacttacataaaataaacttattacttgtttcacaagtttgagttttcaaaataatatttactaaatggcatatttatgtacatccagctgaactttttgcttgaattgggtttctacattttaaaaagtctttcagtaatatacgatttttttatgaatgtttttcatttaataattatgaaatcaagtaaagctaaaaggaatcttaaattcccaatatgatatcatttttttcttctcaaaagtaagtagtaatgaggttttactataaactgttacagcattctttaaaacgacaatgacaataacattttcatcataatacaaatttttgcagatgagttgaatatatcaatgaaagaaaaaaatctactttttcttgtttcctttcacaggcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctgttttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaacta

SEQ ID NO: 453977 - DNA, 3143 bp, Homo sapiens
cgagctcggtaccctcataggttcgcaggtacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctgttttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaacta

SEQ ID NO: 453978 - DNA, 2727 bp, Homo sapiens
tctatagaaaaatgcttgtttctatcaagaatgactcctttataaactggggagtatctttaagagtggtttcaaccctgactgtatagtatcatctgttgaggagcttaaaaaaaatatgtaggcccagcccacactagactggcattggtacctggtatcagtattttttaaaaacttcccataggattctaatgtacagccaagattgaggaccatttgtctgtcatctgggattatgcttaataaattaatactgttttttaaattaattagatttcacttctaagtcattatcagtaaatttactcagtatctaactgacaagaatttctagcatatatttcttgattagtgcatgtaaaattctaaaagaatttctatagtattttccaggcaataagacaactagtgccccaaatttaccaaatgcatgagtctaagcctgtgctatatataaatatactcaaagccaagtttacatctgtgtacacaagtgtgcatgcatatgtacaattaaagactatagttgtaacagtcatgagcttgtgttttgattttactcctattcctgtattgtattaagtgtactatcatgttcttgaggcatatctccaggagatatgtttatttcttttccaggaaaagtgggacatatataagtagggtaaacgctagagctagatactcctttaatctctattacgtcagatctctggctcccttttacaaccaggcaatcttcaattataggtggctaatagggaagaaaatcatcggcagagcaacagcttcatgtaatttcagagtagaaaaatgaattttaatcttctgaaaggtaatattagaattagctggattgctacacttaggaatcataggttccaaataaatatcagtacatacggaaatcagataatgggacagattatttgaaattagggctgcctagaaatctggaatgtgagatcaccctccttctgaccaaatatgcttgaataaacttaatattccaaattatgtgagggattgcctattgtgcaaaaaaaaaaaaacgaaatctgaatttaaaaaaaattaccacagtctagtattattttagtctcttggatgttataacgttatctgttccatctgttgttaatatgagacactgtacaaacaaacaactatattgatttagaatcagtatagatcacctagctttttgtctcaattttcctactttaatgctcttggggctttcgcttttgattttcagttttttccttaaaataattaatattgttgaaattagactttctaaatttaaatttatcagaatttcctatgtaaaatgagtctaggcaccaaatgtttaatgactttaaaaaaaatgtttatgactataaaaggaaaaaccctgtatcaatttcaagcttgttttatatccaaagtgctagttattttgtgatgagaatatatgccccaagaacatttttgaaagacatataattagtaacttttttatttttcaacttacataaaataaacttattacttgtttcacaagtttgagttttcaaaataatatttactaaatggcatatttatgtacatccagctgaactttttgcttgaattgggtttctacattttaaaaagtctttcagtaatatacgatttttttatgaatgtttttcatttaataattatgaaatcaagtaaagctaaaaggaatcttaaattcccaatatgatatcatttttttcttctcaaaagtaagtagtaatgaggttttactataaactgttacagcattctttaaaacgacaatgacaataacattttcatcataatacaaatttttgcagatgagttgaatatatcaatgaaagaaaaaaatctactttttcttgtttcctttcacaggcaatgataccgtctttatccaagttactctgccccatggcccaagttagtatatttggtttaagactcataattcttgctttggctttaaaaatcaaaccaagtgtaacctttcctgctaaaactcttcttgggtctggcagcattggtaccttgcttgcaacatcctagaagtgaggccttcacttgtgctatctttagatcataagtgatttgcttaaatttatatatttctcatgctttttataaaaccttgtttctctcttaaaagaacatattaaataagtggcttccacatttaaccatttcttttttccaactatagagttctaagtatattttaatgctcaactttgaaaaaaaaaaaaaggcaagagcatgcatgcgcatatgggaatgctggcagctacatgcagtttctaaatcacaaaatatacttagcctgatggcaggatagattatagacaactgcttttgactttagaagaactttcttataattgtaattattcaaagtatagcctaaatactgataaacaaaataaagttccattttaattttaaggtaaactaacaagtcactaaattccattattttaattatttaagctaatatttttttgctgtcctttcatacaatttcaaaatatgtacaatggaaaatactagttacaagctgaattaactatattcttaagaaaaaaggtaggtgatcaaaatgttgatcatttaaataatatcagtacacaaagtactctttttaagttctatattttataacatatgacaaaataaaaagcttaatgcttaaaggga

SEQ ID NO: 453979 - DNA, 2473 bp, Homo sapiens
gattccccaacaacgacctccggtccttccccttccccgcgagacctccgccccagctccgccccgcccggggctcttgcgtttcggagtcccaactacgcggagcgggcgccgcggccggagcgtccctccacacgtcctcccccagccgccagctccgccgcggggccagaccgggcccgggacgccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcaggtaagaattatgcagttgcctgtcacttttgttttcctgcttcaaactgattttctttcctgcatgggtttattgtgcctaaaatagaaaagaaactaacaaccaaagacctcttttctttgactaaaaataccccactttatatttctttggaatgttttactttttctactacacttaaatacttttttttaaccttaccatcagttatagatgagaaaatgaggtcacttggctaaatttatccagttagaaagtgacagaaacaagactaaagttagtagtaaatcatcattattggcatctaaaaagttttttactcctttatcttttttttctttcttctttttccatttctgagattataaataaaaattttaatataac

SEQ ID NO: 453980 - DNA, 1187 bp, Homo sapiens
gattccccaacaacgacctccggtccttccccttccccgcgagacctccgccccagctccgccccgcccggggctcttgcgtttcggagtcccaactacgcggagcgggcgccgcggccggagcgtccctccacacgtcctcccccagccgccagctccgccgcggggccagaccgggcccgggacgccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgtaagtatcattgtatatatgcctctcattgaatgtgttgtgaaatttgcatgaccacttcaaatttgaagttgtacagttcatcattactaatttgttaatttttttaagttgtgggacttaattcatgatcacaaagttttacaacagtttcaagagatttaacattagaaattaagagacaaaatacaaagtagactgattatgtaagtgaaaatgaattcacagaattctccatg

SEQ ID NO: 453981 - DNA, 800 bp, Homo sapiens
ctttgaaataatgtgtcacaacagattgtatgcagaaatagatatgaaaatcctgctgtcttctagtacgctatgttagagatttgcaaatgtaaaacattgccattcttctactaaatgttttttgttatggcttaaaaaaaatttggttactttttataaaagtgctatttatgttaaacacataatgggtttattatttttaatgaattaaatattttttgaaatttttggttttaacttctaatatggtaaacattgaaatacatagttataaacaaaaggtttttagaatcttcaataatttttaagagtgtgaaggagtcctgagaccagaaagttacaagaccactgacctagagaaatgtatttgcaaattgtacacctttgcagaaggaattcttgaattgtcctttattcatatttctaagtcattaaaatttttcactgtgtctgacatgttaaattttgtgattataaaatgacttattggctcaaaatttgtttaatattataataatacagcctcactgaattaatgtgttttcccccaaacaggatgtagaaaatatatttagtcgcatagtagatatacatgaacttagtgtaaagttactgggccatatagaagatacagtagaaatgacagatgaaggcagtccccatccactagtaggaagctgctttgaagacttagcagaggtaagtacttcaattatatacccgaaaagtctgcataaaagcctacatttacattaaaattgagagtcttacttctttccagctaaagtcatagatac

SEQ ID NO: 453982 - DNA, 338 bp, Homo sapiens
agacctgggcacatagagacttttgacctgctcaccttacacccaatagaaattgctcgacaactcactttacttgaatcagatctataccggtatgtaatttaacattcaagttgaaaagtcatttcaaaagagttaacttttaaaatgaaatactgatttctgccttatagggttttcataagacttaactgaaatattacatgaagtgtctagtaataaggccaggcaggcagttcctgttcttttactcccctggtccctctagctgaatttacaccttctgtctttctgtgttcacccctagttggtaaggctaggttcaaatcctggcttta

SEQ ID NO: 453983 - DNA, 696 bp, Homo sapiens
taagtgaagagcactatttaatatattttttgcttagttgttattttcctattttccaaggaacgtgttcaaaaaagtttccctcatccaattgataaatgggcaatagctgatgcccaatcagctattgaaaagaggaagcgaagaaaccctttatctctcccagtagaaaaaattcatcctttattaaaggtaatgctgaactactgccttcttgccttttaagggaaaaataaaacccaccatttttatacaataagaatatattttatggataattgagtcaacttaagagtaaaattctctcattctaagttttccagagatttatgtggtgagaagggatgctatgataataagaaaatataaactgggcaacatgatttaaagtaatttcatatcaatagtaataagcaagttgagaggactaagaaagttattgtggattttgtttatctcagatgtaattaggaccacaaagagaatttataaaactcctcctttcttgttggttagacctaagtgttcctataaatccttttgatgttagtactttgtgtagagacctctgtgaaaaggctacaaggctatgtgtaatcttggaacaaaaagataacctaaactctccagtcctacttatcatgtaaataagtcagtcagtcagttgaatctctatagaactaatagaataactgc

SEQ ID NO: 453984 - DNA, 113 bp, Homo sapiens
tgtgtggacaaaagaagacaaagaaattaactctcctaatcttctgaaaatgattcgacataccaccaacctcactctgtggtttgagaagtaagtattcctagcattcttat

SEQ ID NO: 453985 - DNA, 5405 bp, Homo sapiens
attggctcaaaatttgtttaatattataataatacagcctcactgaattaatgtgttttcccccaaacaggatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctgttttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaacta

SEQ ID NO: 453986 - DNA, 5432 bp, Homo sapiens
ggccccgacgtgaagtgagagaagatgcaagaaggagatagacaaagggaaacacctgtttccctgtgtctccgattcaaaatggttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaaagcctattcaccacgatattcaatatcagaccggacctctatctcagaccctcctgaaagccctcccttattaccaccacgagaacctgtgaggacacctgatgttttctcaagctcaccactacatctccaacctccccctttgggcaaaaaaagtgaccatggcaatgccttcttcccaaacagcccttccccctttacaccacctcctcctcaaacaccttctcctcacggcacaagaaggcatctgccatcaccaccattgacacaagaagtggaccttcattccattgctgggccgcctgttcctccacgacaaagcacttctcaacatatccctaaactccctccaaaaacttacaaaagggagcacacacacccatccatgcacagagatggaccaccactgttggagaatgcccattcttcctgagttcctctgtactgggatgtatattttcctagccccaaatccattgctggcaatggatgcactgaatgtgccagcactgaggagttaaaatgagaactccaaacactaacgactcttcttcaagatgcagtataagacaatgaattttaacctagatgtaattatacaatggaaatggtattccagtttagaatatggaaagaccgacctagaggaattggacaactgattgcacctgaaaatcataaagggactttttctggccaataggcaggagtcctctttttgtgaagtgatcttttgtgaagtgatcattaaagggatggaaaacacagtctagtgtccagcaggcccacatgacagtttttgtaattcaaattatgcacttttaaaaaaaaacaaacttaaacagggatcttaatatcttcctttgttttcctttgctttactcttctactttagaatattttcttaaaaatcactcaaaggactgtgaggaaaggctgtggtacctgaccttgttgaaatcaaggcccggcactgtactacaggcctgtttacagattattacggtgaactgaatgggtaccgaggcttcaccaaagaggtacttttttgttgttgttgttgttttaggaataattgtaccaattttaagagcattccccccacctgtccccacacacccaaacaaaatgtggtggtgttgccttcaaaaaagagaagttttgtgtcattaacatgacagaagaactttttaaaaaaaaataactgtcaactattctatttgcatttaggagactgttcatctatgctagattgtcattttccctccttctcccacagaagtttactggtagtccatgtcatggctcgtagctatccctctaaccataccatggaaatgcaggcacccaatgtgaaaaggagcacttgctgggcatcactgacaccgctcatgttttacacatagttgagtaatcagcatatctagaattatcttgcattgcctaaatcatatgtatatagtgaatgttatataatatacctggcaggtctgttttaatttaattgaataaagatacaaatactttgtttggctggcatatattaaattattatatgaagaaaatggttgattcttatttcttttagttgaaaaacacacaaaaacactaaacataaaagcacgttttgtggtacgccttggtttctagttctggatatatgtattaatcttaaagaatgatctaaagtcacagcttggcatataggaagatacttggttagaataggatgggtatcttttaagcagaactttgtaagtaagttttaagttcctaagcaacaagtatacagtttgttaaggtttatattgaacattctaccttgcttgaggttttctgctttatcaaaactattcataatagaacatctacctgcatcattactatcataatatggattattcataaagcgtatgtactgttcttctgagtctaacaaatactgtgactgaaatgcatgcaccttgttgaagagaaaacattttattaatctccactataatgtctgtgaaatgtgcagtattccatccttagagagttatctggttcatcagcatctgcatgtatcctctgaataatgaagcaacatttcagcaattctgttaaccacaccattagagacatttttagaagtgctgcaacatggtgggaacctagtactttaataatttcctatgatatttattagagcataaaatgtacatcacgatagtacagtatgtagtcctttaagaccagaaggtatgttaactgcaccatcattaagcagtctatcctgttttcttatttatttgttagaattgaatcctttctcaatatctgtaccattcctatgatggtagccattcttctctttataaaatatttcctctttgaaaagcgtcctaaaacattaatttcaaatcccctcttggatgcaaagtgtccctaagaccatccattcaacagtatttatgtgagccaacttactagagccgctacaacta

SEQ ID NO: 453987 - DNA, 3959 bp, Homo sapiens
gattccccaacaacgacctccggtccttccccttccccgcgagacctccgccccagctccgccccgcccggggctcttgcgtttcggagtcccaactacgcggagcgggcgccgcggccggagcgtccctccacacgtcctcccccagccgccagctccgccgcggggccagaccgggcccgggacgccgccgcccctctccccgcccagaggcgccccgggggcaccatgcaggcgcagcagctgccctacgagtttttcagcgaagagaacgcgcccaagtggcggggactactggtgcctgcgctgaaaaaggtccaggggcaagttcatcctactctcgagtctaatgatgatgctcttcagtatgttgaagaattaattttgcaattattaaatatgctatgccaagctcagccccgaagtgcttcagatgtagaggaacgtgttcaaaaaagtttccctcatccaattgataaatgggcaatagctgatgcccaatcagctattgaaaagaggaagcgaagaaaccctttatctctcccagtagaaaaaattcatcctttattaaaggaggtcctaggttataaaattgaccaccaggtttctgtttacatagtagcagtcttagaatacatttctgcagacattttaaagctggttgggaattatgtaagaaatatacggcattatgaaattacaaaacaagatattaaagtggcaatgtgtgctgacaaggtattgatggatatgtttcatcaagatgtagaagatattaatatattatctttaactgacgaagagccttccacctcaggagaacaaacttactatgatttggtaaaagcatttatggcagaaattcgacaatatataagggaactaaatctaattataaaagtttttagagagccctttgtctccaattcaaaattgttttcagctaatgatgtagaaaatatatttagtcgcatagtagatatacatgaacttagtgtaaagttactgggccatatagaagatacagtagaaatgacagatgaaggcagtccccatccactagtaggaagctgctttgaagacttagcagaggaactggcatttgatccatatgaatcgtatgctcgagatattttgcgacctggttttcatgatcgtttccttagtcagttatcaaagcctggggcagcactttatttgcagtcaataggcgaaggtttcaaagaagctgttcaatatgttttacccaggctgcttctggcccctgtttaccactgtctccattactttgaacttttgaagcagttagaagaaaaaagtgaagatcaagaagacaaggaatgtttaaaacaagcaataacagctttgcttaatgttcagagtggtatggaaaaaatatgttctaaaagtcttgcaaaacgaagactgagtgaatctgcatgtcggttttatagtcagcaaatgaaggggaaacaactagcaatcaagaagatgaacgagattcagaagaatattgatggttgggagggaaaagacattggacagtgttgtaatgaatttataatggaaggaactcttacacgtgtaggagccaaacatgagagacacatatttctctttgatggcttaatgatttgctgtaaatcaaatcatgggcagccaagacttcctggtgctagcaatgcagaatatcgtcttaaagaaaagttttttatgcgaaaggtacaaattaatgataaagatgacaccaatgaatacaagcatgcttttgaaataattttaaaagatgaaaatagtgttatattttctgccaagtcagctgaagagaaaaacaattggatggcagcattgatatctttacagtaccggagtacactggaaaggatgcttgatgtaacaatgctacaggaagagaaagaggagcagatgaggctgcctagtgctgatgtttatagatttgcagagcctgactctgaagagaatattatatttgaagagaacatgcagcccaaggctggaattccaattatcaaagcaggaactgttattaaacttatagagaggcttacgtaccatatgtacgcagatcccaattttgttcggacatttcttacaacatacagatccttttgcaaacctcaagaactactgagtcttataatagaaaggtttgaaattccagagcctgagccaacagaagctgatcgcatagctatagagaatggagatcaacccttgagtgcagaactgaaaagatttagaaaagaatatatacagcctgtgcaactgcgagtattaaatgtatgtcggcactgggtagagcaccacttctatgattttgaaagagatgcatatcttttgcaacgaatggaagaatttattggaacagtaagaggtaaagcaatgaaaaaatgggttgaatccatcactaaaataatccaaaggaaaaaaattgcaagagacaatggaccaggtcataatattacatttcagagttcacctcccacagttgagtggcatataagcagacctgggcacatagagacttttgacctgctcaccttacacccaatagaaattgctcgacaactcactttacttgaatcagatctataccgagctgtacagccatcagaattagttggaagtgtgtggacaaaagaagacaaagaaattaactctcctaatcttctgaaaatgattcgacataccaccaacctcactctgtggtttgagaaatgtattgtagaaactgaaaatttagaagaaagagtagctgtggtgagtcgaattattgagattctacaagtctttcaagagttgaacaactttaatggtgtccttgaggttgtcagtgctatgaattcatcacctgtttacagactagaccacacatttgagcaaataccaagtcgccagaagaaaattttagaagaagctcatgaattgagtgaagatcactataagaaatatttggcaaaactcaggtctattaatccaccatgtgtgcctttctttggaatttatctcactaatatcttgaaaacagaagaaggcaaccctgaggtcctaaaaagacatggaaaagagcttataaactttagcaaaaggaggaaagtagcagaaataacaggagagatccagcagtaccaaaatcagccttactgtttacgagtagaatcagatatcaaaaggttctttgaaaacttgaatccgatgggaaatagcatggagaaggaatttacagattatcttttcaacaaatccctagaaatagaaccacgaaaccctaagcctctcccaagatttccaaaaaaatatagctatcccctaaaatctcctggtgttcgtccatcaaacccaagaccaggtaccatgaggcatcccacacctctgcagcaggagccaaggaaaattagttatagtaggatccctgaaagtgaaacagaaagtacagcatctgcaccaaattctccaagaacaccgttaacacctccgcctgcttctggtgcttccagtaccacagatgtttgcagtgtatttgattccgatcattcgagcccttttcactcaagcaatgataccgtctttatccaagttactctgccccatggcccaagatctgcttctgtatcatctataagtttaaccaaaggcactgatgaagtgcctgtccctcctcctgttcctccacgaagacgaccagaatctgccccagcagaatcttcaccatctaagattatgtctaagcatttggacagtcccccagccattcctcctaggcaacccacatcaaatatttgaggatcatccttctcacctgccttaactactccttggaccctagatgtaaatttctcagtagcttatctatgctatggtgtcacctgatggcctagcattaaccaattcatgccaacttctgaatgatgaaaccagtctttacagacagtagttcc

SEQ ID NO: 453988 - DNA, 1040 bp, Homo sapiens
  misc_feature (34)..(34): n is a, c, g, or t
  misc_feature (902)..(902): n is a, c, g, or t
  misc_feature (907)..(907): n is a, c, g, or t
  misc_feature (909)..(909): n is a, c, g, or t
  misc_feature (914)..(914): n is a, c, g, or t
  misc_feature (918)..(919): n is a, c, g, or t
  misc_feature (928)..(928): n is a, c, g, or t
aatatgctagaggacgagcccagagtctacgtgnagcacatgaggtgctgagcagctggagggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgagccgtgggttttcggcctgtgtgtcggggggctttcntgcangnggagncccnntgggccggngtggtccccctgggggtgtccccttttcgggggttgttggcgcccgggtggaagggggggtcccagtttcttgtgcgtggcctcggttatgcgaccccgggggaaaatctgg

SEQ ID NO: 453989 - DNA, 480 bp, Homo sapiens
ccaccaagttcagagagtctgcgggttcctagcagtgtcttttggagtaccagtttacaagaggaaagttgaaagtagttccatattacctcctttcttttcctactcttttaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 453990 - DNA, 411 bp, Homo sapiens
aattcgcggccgcgtcgaccgagaagacgacagaagggtgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 453991 - DNA, 403 bp, Homo sapiens
actactaaattcgcggcccgtcgaccggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 453992 - DNA, 653 bp, Homo sapiens
tactactacattcgcggccggtcgacttctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaaaaaaaaaaaaaaaaaaaaaaaaccccgcaaaaatgtcctctctctctcctctcctccccgcgcccctctgggcggggtggcgcaaacaacacagcgccgccttacaaaacgcgccggccaaagggcgcccaaaaaaaagcgcggtgccccttctcttaaaaatgttggttctgtcttgaacccccggtatcgtctcttacacatcttggcaaccccgt

SEQ ID NO: 453993 - DNA, 557 bp, Homo sapiens
cgccccagcatactctccgggtcctcgctggcggtgggcgggccagggaggacaagcactggaggtgtgcccgtagccggacttgcttcagctgtcgatagtcgaggccgttaacccttgcggtctcggtcctgtccactccaaggccgcctcgattgacgacgattagccttctcccagctgcgcttccctcctcccagctgcgcttccctcctccccacgccttcacgggaaggcactcgtcttgcgccagggggtcttccgcccagtgccaccaacgcttgcgcgctcaccgtggataggcgctggggccgcggcctgcgcacgccatccacgaggagcctctggccagtgcaaagccagaaaacgggcattgggggcagcttcccacgctcgtcccgttgacactgactatgtaactgtgacactggacaccttgacctctcagcctcctttctgtcatcagtaaaatggccttaataggaccaacgcaatagggttgtgaggattaaatgagatcgctcacgtaaagtgctttggcaccagcctatcccaca

SEQ ID NO: 453994 - DNA, 1876 bp, Homo sapiens
aacttaggctaggtacgaggccgggtggtgttgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 453995 - DNA, 2187 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaaaaaaaactcgagactagtttctctccagaaatcctgggcccccagaagaccttttgcccacacacactcctttcccccttgtccctggggcactcccccaggtttgtcgcactagtcagagtgtcccttttggcaggggactgggcccaggggtcctcggccattctgtccatcctcctctccatgcaagtgctgttggggcaggagtccccatgccgggtgtgacttcggcaaccacgtacaaggccacccagctgctgcatctgtgcctgtccgagaactgatctc

SEQ ID NO: 453996 - DNA, 2022 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaaaaaaaaaaaaaaaaaaaaaaaacacaaaaggggggggtcaaaatatcggggcaaaaccaccttttaaaggccaaaagaaaaaaaggggggaaccgggaaactgttgtagaccctggggataac

SEQ ID NO: 453997 - DNA, 2156 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaaaaaaaaaaaaaaaaaaaaaaaacctcggagggctctctattggtcgggggggcgggaagaaagagagggtatgtgagaaattgggcccatgtgggccatatagcgcgtggttcccctggagcccaaggctttccttggggtacaaaggggggtagaattcgtggcgcgggttctccctatattaggggagggctcggatattaaatttccggttaaggccagggttacccgggcatttaattggattcccgggaaat

SEQ ID NO: 453998 - DNA, 1908 bp, Homo sapiens
  misc_feature (1851)..(1851): n is a, c, g, or t
  misc_feature (1871)..(1871): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctctnttcttttaaacactccgacngggggggattcttaaattctttagttgagctttcatg

SEQ ID NO: 453999 - DNA, 1902 bp, Homo sapiens
  misc_feature (1842)..(1842): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaagaacaagagggtgtaatttngggccccaccctcttcaaatccctttagggtgggaggccctactttaaattaaaatgacc

SEQ ID NO: 454000 - DNA, 1816 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454001 - DNA, 1721 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccagtgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454002 - DNA, 1681 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454003 - DNA, 1289 bp, Homo sapiens
  misc_feature (1247)..(1247): n is a, c, g, or t
  misc_feature (1260)..(1260): n is a, c, g, or t
  misc_feature (1266)..(1266): n is a, c, g, or t
  misc_feature (1268)..(1268): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagagggggacaggacaatttttactgggtgcccaggccagaatgcccttcatctcggggggcgccacanttgggggaaaaanggccgntntgcaaatcgagggccagaaaa

SEQ ID NO: 454004 - DNA, 2347 bp, Homo sapiens
ttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcattgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaattaaagcttattttcattaacaaaaaaaaaaaaagagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454005 - DNA, 1200 bp, Homo sapiens
  misc_feature (1054)..(1054): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggcggtcgngggtctggggcaggggcgggggcccccgctgttgccgtcccgtggtcttcgggttcaccctgggcggcctcggccgcacgcctcgggcctgggaagcctctcggccaggggggtccccttcccctgcccgtgactggtccggtcct

SEQ ID NO: 454006 - DNA, 1072 bp, Homo sapiens
  misc_feature (914)..(914): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgagacccgggaggattcagcantgtgtgctgggggaacttcttgcagttaggaaaacccatcgggcagggtggcaatccagggggcccgaatggaaagacgcggcggcgaacgggccgaaggaagggcgggcaccaggaagtcaagggtccgcggaaccggggccgggcggaacacgggg

SEQ ID NO: 454007 - DNA, 1859 bp, Homo sapiens
  misc_feature (34)..(34): n is a, c, g, or t
aatatgctagaggacgagcccagagtctacgtgnagcacatgaggtgctgagcagctggagggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454008 - DNA, 1834 bp, Homo sapiens
ttaatcatgatctgcggcttattaatgatttactggctgtcgtttaacatagcttcatatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454009 - DNA, 1994 bp, Homo sapiens
  misc_feature (23)..(23): n is a, c, g, or t
  misc_feature (28)..(28): n is a, c, g, or t
aataacggcctaggtacgagctngggtnaatcggcacgagggagaagaggggagagtggcgggccgctgaataagcttccaaaatgatgaaggtgccaggactgggccagctgaagagccagaaagaatgctgggagtatagagaagccatttcttgccaccagacctgggacactccagcaaaaggaaggaattttcccttcagttgacgcctgatcccaaatcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454010 - DNA, 1852 bp, Homo sapiens
gggtgtgttgctggtctccctgatcgtgagtcgtgattgatacagattaagcgacggtaaactagccttccatgaatcagtgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454011 - DNA, 1877 bp, Homo sapiens
aaaaaatataaaaaaaaataaacgtttccgcgaagaccggtgtagacgcttctgctgccgaggcctgtcccgcgcggagtggggagtggtggtcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454012 - DNA, 1629 bp, Homo sapiens
  misc_feature (23)..(23): n is a, c, g, or t
  misc_feature (28)..(28): n is a, c, g, or t
aataacggcctaggtacgagctngggtnaatcggcacgagggagaagaggggagagtggcgggccgctgaataagcttccaaaatgatgaaaacgtgtatttcctgtcatcatcttccaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454013 - DNA, 1598 bp, Homo sapiens
  misc_feature (23)..(23): n is a, c, g, or t
  misc_feature (28)..(28): n is a, c, g, or t
aataacggcctaggtacgagctngggtnaatcggcacgagggagaagaggggagagtggcgggccgctgaataagcttccaaaatgatggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454014 - DNA, 1533 bp, Homo sapiens
agttacaagacctagaagtgttttttcagctgtagagtagaaatgcttaggatttgggagtgaacagactcaggactattgagagattgaggtccacttcagcagtttgtctttagcatgagagactcattcaacttctgttcttggcaggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454015 - DNA, 1266 bp, Homo sapiens
  misc_feature (28)..(28): n is a, c, g, or t
cggacgcgtgggtcgacccacgcgtccntggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454016 - DNA, 1279 bp, Homo sapiens
tggcgaattcggcacgagggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaaagaagtacccttggagttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454017 - DNA, 1030 bp, Homo sapiens
tgggtgtgaatcggcaccgagggtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454018 - DNA, 1086 bp, Homo sapiens
cggtccccatgcacagttcggtccccatgcacagttcggtccccatgcacagttcggtccccatgcacagttcggtccccatgcacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454019 - DNA, 866 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgagatctcagtggaaccgggtgtgctccaaaaattctctaaccgggttgaatgacccccaatttcccaatcccaaatggcgcttgaagtggcagcccgtttataccggacaaccgccgccaaagccccccggagtctcc

SEQ ID NO: 454020 - DNA, 926 bp, Homo sapiens
  misc_feature (486)..(486): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagcttnttcgcgcacaggccaacctccagctggacatacaatcagaatggtgacggaagcatagtgagcagagagcggaagtgtgcatgacgtctggctcagctgatctcagaagctctgctagatgggatgcggatgatgctcatgatgctgttaagatgatcaagtcgggagctcgagatctcgtgtactgtgtgtcaagatttctacgcgggtgaatgcaccaaagtaccacaatcccaagatgcctttgtgtcgagctcgagtgaaagctgaaaagacagctgagatgagtccaaagttgagtatcgcatgtgagcgaggaaatctcatcaagtaaaaaccacatcgaccagtgtctgtcaatccatgggatgggcacagtattgctgacggaatgtcgcgggatactgaggatcgagagaatgaggctggaggtcaacaac

SEQ ID NO: 454021 - DNA, 779 bp, Homo sapiens
ccaccaagttcagagagtctgcgggttcctagcagtgtcttttggagtaccagtttacaagaggaaagttgaaagtagttccatattacctcctttcttttcctactcttttaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaaaaaaaactcgagactagtttctctccagaaatcctgggcccccagaagaccttttgcccacacacactcctttcccccttgtccctggggcactcccccaggtttgtcgcactagtcagagtgtcccttttggcaggggactgggcccaggggtcctcggccattctgtccatcctcctctccatgcaagtgctgttggggcaggagtccccatgccgggtgtgacttcggcaaccacgtacaaggccacccagctgctgcatctgtgcctgtccgagaactgatctc

SEQ ID NO: 454022 - DNA, 1043 bp, Homo sapiens
  misc_feature (23)..(23): n is a, c, g, or t
  misc_feature (28)..(28): n is a, c, g, or t
  misc_feature (885)..(885): n is a, c, g, or t
aataacggcctaggtacgagctngggtnaatcggcacgagggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgagacccgggaggattcagcantgtgtgctgggggaacttcttgcagttaggaaaacccatcgggcagggtggcaatccagggggcccgaatggaaagacgcggcggcgaacgggccgaaggaagggcgggcaccaggaagtcaagggtccgcggaaccggggccgggcggaacacgggg

SEQ ID NO: 454023 - DNA, 995 bp, Homo sapiens
  misc_feature (886)..(886): n is a, c, g, or t
  misc_feature (893)..(893): n is a, c, g, or t
  misc_feature (902)..(902): n is a, c, g, or t
  misc_feature (907)..(907): n is a, c, g, or t
  misc_feature (911)..(911): n is a, c, g, or t
  misc_feature (915)..(915): n is a, c, g, or t
  misc_feature (918)..(918): n is a, c, g, or t
  misc_feature (920)..(921): n is a, c, g, or t
aaaaaatataaaaaaaaataaacgtttccgcgaagaccggtgtagacgcttctgctgccgaggcctgtcccgcgcggagtggggagtggtggtcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggnttagggntccccccgntgggngttntccngcntnntggtgctgggggggacttctctttgaccggttggggaggtcctcttcggggcccggtgttggtccccccctggg

SEQ ID NO: 454024 - DNA, 424 bp, Homo sapiens
tactactacattcgcggccggtcgacttctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454025 - DNA, 1888 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454026 - DNA, 2033 bp, Homo sapiens
  misc_feature (1910)..(1910): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaacaaaacaacancaccccgggcaccaaagacgggccggaaacagggtacgaagggccgtgccaaacggaacggacccatttcggtccagggcaacgggggccccatgggcgataaccaagccgtcgtccacccca

SEQ ID NO: 454027 - DNA, 2203 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaaaaaaaaaaaaaaaaaaaaaaaaaaaaaaatttggggggcgccgcggccctaaaaagttttaaacacataccggtggggcgcggccggcgggcgcccaagtagggtaagtcggaggacacatgtggggccaaacgctgggtgcccaaagggaaacccgggcgcacgaacatagcggcgggggtttctccccacttaaaaaaacgcggcggggggggacccggacgcgttctggaaacaaacccagaaggggggtcagaagcggcaaggggtctacaacagggagcccaaggaaggcaaaaataaaatagcgcggg

SEQ ID NO: 454028 - DNA, 2255 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttcaccaataatggacaaccccctcgctttcacaagtccctcgcaataggtagtcttctgatgtcacccatgccagccctaggatgaggggaccctgacatgtgtcttcctacccaccaaggtgcctgaaccccgaggcccagcaagaccatcccgtggtggtccgccctactttcattaagatcgcagccttgggtctcctgtagtgatgttaccaccgcatgtcttgttgtgagcccagcccggagttctcgtggcaagacagctacgcctcaagcgagatcggcctccttcccgctaatttgcatggacaatgctagaaggccggtgagtgtgaggattggccccggacttgttggcccacggaaact

SEQ ID NO: 454029 - DNA, 1887 bp, Homo sapiens
  misc_feature (1824)..(1824): n is a, c, g, or t
  misc_feature (1827)..(1827): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaagnatngggcccccttttacgggggtttataatgtgttgaaaaaaaaaaccggctttggggaaata

SEQ ID NO: 454030 - DNA, 1874 bp, Homo sapiens
  misc_feature (1743)..(1743): n is a, c, g, or t
  misc_feature (1874)..(1874): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgccccagganagggaccaccataatggttggtgctgtggtgcttcctcctggctggttctcctttcaagcaggggtgatggcctttttggggttaaagggatcaaacacacaaaaacggtttttggcaagaaggcggtcgn

SEQ ID NO: 454031 - DNA, 1831 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454032 - DNA, 1476 bp, Homo sapiens
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454033 - DNA, 1859 bp, Homo sapiens
  misc_feature (23)..(23): n is a, c, g, or t
  misc_feature (28)..(28): n is a, c, g, or t
aataacggcctaggtacgagctngggtnaatcggcacgagggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454034 - DNA, 1044 bp, Homo sapiens
  misc_feature (897)..(897): n is a, c, g, or t
  misc_feature (924)..(924): n is a, c, g, or t
  misc_feature (928)..(928): n is a, c, g, or t
  misc_feature (938)..(938): n is a, c, g, or t
  misc_feature (942)..(943): n is a, c, g, or t
  misc_feature (954)..(955): n is a, c, g, or t
tcccaggcgtcgagcttctgggtatttctattgcgcgaggcattgtgggttgctgggcggcccggtctcggagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggntatcagcactggtgatgctggtggaanttcncttgacagtnaganntcctctctggnncagtggtcggcccatcccttggggggtgcccgattgtggcggaatttcggcgccccgggccaagaagggggggcccccggggtgtggcc

SEQ ID NO: 454035 - DNA, 1868 bp, Homo sapiens
  misc_feature (63)..(63): n is a, c, g, or t
  misc_feature (68)..(68): n is a, c, g, or t
catgatatgaagtgcgtactcgtttcaatttcatcacaggcggcctgtcttggaattatgganagtgncgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454036 - DNA, 1972 bp, Homo sapiens
aacttaggctaggtacgaggccgggtggtgttgtgggttgctgggcggcccggtctcggagaagaggggagagtggcgggccgctgaataagcttccaaaatgatgcattgctcattcttgaagtcgtcttcatcttctgtgcagaggcagcatagtacagcagttgagagtaaggcctctggagctacactgaatgcctagcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454037 - DNA, 2029 bp, Homo sapiens
cagcagccccaggtcgggagaggcgagcaggccgtcggggggtgccgcgctgggggcgccgtcggcgcgcaggggggtaggaggcggcgcggccgcaggcttgagcgctgccgccacctgctcactcaggctcagcgtcagcgcgtccttcttcatcatgctgccggccgcggccgtcgggggcgccccggggaacaagcggcccggggacgcgaagctgccgccgctgccactggcgccggcaccgagcaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454038 - DNA, 1798 bp, Homo sapiens
  misc_feature (28)..(28): n is a, c, g, or t
cggacgcgtgggtcgacccacgcgtccncccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagaggcaaagcaacaatttctaatgatggggccacaattctgaaacttcttgatgttgtccatcctgcagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454039 - DNA, 2281 bp, Homo sapiens
ttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcattgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaattaaagcttattttcattaacaaaaaaaaaaaaagagaagaggggagagtggcgggccgctgaataagcttccaaaatgatgcccacaccagttatcctattgaaagaggggactgatagctcccaaggcatcccccagcttgtgagtaacatcagtgcctgccaggtgattgctgaggctgtaagaactaccctgggtccccgtggcatggacaagcttattgtagatggcagagcaaagactttggtagacattgccaaatcccaagatgctgaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454040 - DNA, 1553 bp, Homo sapiens
agagctcctcagtctaagccaagtggtgtgtcatagtcccctggccccattaatggattctgggatagacatgaagaccaagccaggtgggatgggtgagtgtggcttctggaggaagcggggacacaggacagcattctttcctgctggaccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454041 - DNA, 1264 bp, Homo sapiens
aacttaggctaggtacgaggccgggtggtgttgtgggttgctgggcggcccggtctcggagaagaggggagagtggcgggccgctgaataagcttccaaaatgatggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454042 - DNA, 1121 bp, Homo sapiens
tggcttacaatgggggcggcacgaccacggcccggtctgctgactgtgggagcatccacattttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454043 - DNA, 1059 bp, Homo sapiens
gagaaagactatgctagagtatacagagtcgcttacacgaagttggacggattggtcaggcaaattgtctgcatggcgtgagatgtgaagatgcctctactgcacaatgctttagcactacagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagaggtacaatttttttactggctgccccaaggccaagacatgcaccttcattctccgtggcggcgccgagcagtttatggaggagacagagcggtccctgcatgatgccatcatgatcgtcaggagggccatcaagaatgattcagtggtggctggtggcggggccattgagatggaactctccaagtacctgcgggattactcaaggactattccaggaaaacagcagctgttgattggggcatatgccaaggccttggagattatcccacgccagctgtgtgacaatgctggctttgatgccacaaacattctcaacaagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454044 - DNA, 1217 bp, Homo sapiens
  misc_feature (23)..(23): n is a, c, g, or t
  misc_feature (28)..(28): n is a, c, g, or t
aataacggcctaggtacgagctngggtnaatcggcacgagggagaagaggggagagtggcgggccgctgaataagcttccaaaatgatgaaaacgtgtatttcctgtcatcatcttccaggtgggtgatggcaccacctcagtgaccttgctggctgcagagtttctgaagcaggtgaaaccctatgtggaggaaggtttacacccccagatcatcattcgagctttccgcacagccacccagctggcagttaacaagatcaaagagattgctgtgaccgtgaagaaggcagataaagtggagcagaggaagctgctggaaaagtgtgccatgaccgctctgagctccaagctgatctcccagcagaaagctttctttgctaagatggtggtggatgcagtgatgatgctcgatgatttgctgcagcttaaaatgattggaatcaagaaggtacagggtggagccctcgaggattctcagctggtagctggtgttgcattcaagaagactttctcttacgctgggtttgaaatgcaacccaaaaagtaccacaatcccaagattgcccttttgaatgtcgagctcgagttgaaagctgagaaagacaatgctgagataagagtccacacagttgaggattatcaggcaattgttgatgctgagtggaacattctctatgacaagttagagaagatccatcattctggagccaaagttgtcttgtccaaactccccattggggatgtggccacccagtactttgctgacagggacatgttctgtgctggccgagtacctgaggaggatctgaagaggacaatgatggcctgtggaggctcaatccagaccagtgtgaatgctctgtcagcagatgtgctgggtcgatgccaggtgtttgaagagacccagattggaggcgagagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaaggaaggggtagtaattggcccactctcttcttactggaggctatttaaataaaatgtaagacttca

SEQ ID NO: 454045 - DNA, 442 bp, Homo sapiens
tttgcgtcccacacttttgcctttattgcattccttggtctggcgtccggggatggaggagggtggaattaagttagtaggtgatgcgggccgagcaaagaccctccgtgctctaagaagcacgaccgaaatgcggcgacccctctttaatgaacgcccctcactagagagtccccgaagcccagcctcaggtccttctagccgcaccgagtcggtggtaacgaaccatagagtagcggaagtggtccgttctcttcctctcccaggcgtcgagcttctgggtatttctattgcgcgaggcattgtgggttgctgggcggcccggtctcggagaagaggggagagtggcgggccgctgaataagcttccaaaatgatggtgagtggcgtctcgcgcatccgtcgccatcagctgccatctggccggtggccggcgccgctcg

SEQ ID NO: 454046 - DNA, 6307 bp, Homo sapiens
gaaaataagaagcaaacccaagagttaaaagcaagagggcttgagaagagagaagaatcagtgaaataatctcttgactggaagactgaagaggagctgttggaggacaggaagatggtctgcagcattgtgtctcccacccaacctggcacagcctttggcaggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacactagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagt

SEQ ID NO: 454047 - DNA, 3508 bp, Homo sapiens
agcctgtagcctgcgagggttctctgacttggataaacccttccaaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagt

SEQ ID NO: 454048 - DNA, 3436 bp, Homo sapiens
gtagctgttcatgttgatttaaatgagtaaaaaatttgaacttttaaattcaatatacacctttaatactgtgcaaatgtttaactcctccacataggtaactgagaatattattttggaaaaaatatgtaagactcatattgtcttgatagagtgttcatctctaactcattcaaactctcttattaaccatgtgccacaaacttaaatagatttctttcattttcagacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagt

SEQ ID NO: 454049 - DNA, 6481 bp, Homo sapiens
agcggactggcggtcgctgttctagcgcgcgagctagttgcctcccgtacctgccgcggtcgccggccccgcccccgggagcgcgggccaatgggctgggctccaggggcggggctggcgggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtggatttcagtttttctgactgttacatgaaaggatgattgctcacaaacagaaaaagacaaagaaaaaacgtgcttgggcatcaggtcaactctctactgatattacaacttctgaaatggggctcaagtccttaagttccaactctatttttgatccggattacatcaaggagttggtgaatgatatcaggaagttctcccacatgttactatatttgaaagaagccatattttcagactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacactagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagt

SEQ ID NO: 454050 - DNA, 6244 bp, Homo sapiens
agcggactggcggtcgctgttctagcgcgcgagctagttgcctcccgtacctgccgcggtcgccggccccgcccccgggagcgcgggccaatgggctgggctccaggggcggggctggcgggcgggcggtgcggccgtggcggtagctgcaggggcggtggcggctgcagtggtggtggtgcctgtggctgtggctgcggctgcggctgcggctgagatttggccgggcgtccgcaggccgtgggggatgggggcagcgagctccagccctcggcggtggcggcggccgtaggtgtggggcgggcgtccgcgtccggcacgcgagatggagcgccgtgactgttttaaagaagttattcatatacgtctagaggaactgctccgtgttttaaagtctataatgaataaacatcagaacctcaattctgttgatcttcaaaatgctgcagaaatgctcactgcaaaagtgaaagctgtgaacttcacagaagttaatgaagaaaacaaaaacgatctcttccaggaagtgttttcttctattgaaactttggcatttacctttggaaatatccttacaaacttccttatgggagatgtaggcaatgattcattattgcgactgcctgtttctcgagaaactaagtcgtttgaaaatgtttctgtggaatcagtggactcatccagtgaaaaaggaaatttttcccctttagaactagacaacgtgctgttaaagaacactgactctatcgagctggctttgtcatatgctaaaacttggtcaaaatatactaagaacatagtttcatgggttgaaaaaaagcttaacttggaattggagtccactagaaatatggtcaagttggcagaggcaactagaactaacattggaattcaggagttcatgccactgcagtctctgtttactaatgctcttcttaatgatatagaaagcagtcaccttttacaacaaacaattgcagctctccaggctaacaaatttgtgcagcctctacttggaaggaaaaatgaaatggaaaaacaaaggaaagaaataaaagagctttggaaacaggagcaaaataaaatgcttgaagcagagaatgctctcaaaaaggcaaaattattatgcatgcaacgtcaagatgaatatgagaaagcaaagtcttccatgtttcgtgcagaagaggagcatctgtcttcaagtggcggattagcaaaaaatctcaacaagcaactagaaaaaaagcgaaggttggaagaggaggctctccaaaaagtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaacagttaacctcttccacatgcagcatctgcaggctgcttcccttgcagacagtttacagtctctctgtgatagtgccaaactctatgacccaggccaagagtacagtgaatttgtcaaggccacaaattcaactgaagaagaaaaagttgatggaaatgtaaataaacatttaaatagttcccaaccttcaggatttggacctgccaactctttagaggatgttgtacgccttcctgacagttctaataaaattgaagaggacagatgctctaacagtgcagatataacaggtccttcctttataagatcatggacatttgggatgtttagtgattctgagagcactggagggagcagcgaatctagatctctggattcagaatctataagtccaggagactttcatcgaaaacttccacgaacaccatccagtggaactatgtcctctgcagatgatctagatgaaagagagccaccttccccttcagaaactggacccaattcccttggaacatttaagaaaacattgatgtcaaaggcagctctcacacacaagtttcgcaaattgagatcccccacgaaatgtagggattgtgaaggcattgtagtgttccaaggtgttgaatgtgaagagtgtctccttgtttgtcatcgaaagtgtttggaaaatttagtcattatttgtggtcatcagaaacttccaggaaaaatacacttatttggagcagaattcacactagttgcaaaaaaggaaccagatggtatcccttttatactcaaaatatgtgcctcagagattgaaaatagagctttgtgtctacagggaatttatcgtgtgtgtggaaacaaaataaaaactgaaaaattgtgtcaagctttggaaaatggaatgcacttggtagatatttcagaatttagttcacatgatatctgtgacgtcttgaaattataccttcggcagctcccagaaccatttattttatttcgattgtacaaggaatttatagaccttgcaaaagagatccaacatgtaaatgaagaacaagagacaaaaaagaatagtcttgaagacaaaaaatggccaaatatgtgtatagaaataaaccgaattcttctaaaaagcaaagaccttctaagacaattgccagcatcaaattttaacagtcttcatttccttatagtacatctaaagcgggtagtagatcatgcagaagaaaacaagatgaactccaaaaacttgggggtgatatttggaccaagtctcattaggccaaggccacaactgctcctatcaccatctcctcccttgcagagtattcaaatcaagcacgcttggtagagtttctcattacttactcacagaagatcttcgatgggtccctacaaccacaagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagt

SEQ ID NO: 454051 - DNA, 3551 bp, Homo sapiens
agcccactgcctcagaagactccctttcatctgttcctactgagctggtcccagccagcagttcagagctgccctctcctgggcagctgcctcccctcctctgcaaggaacccacgcagatgttatgtgtagcataggtgttgttgatcaaggctgttttccaaagcctctgttatcaccagaagaaagagacattgaacgttccatgaagtcactatttttttcttcaaaggaagatatccatacttcagagagtgaaagcaaaatttttgaacgagctacatcatttgaggaatcagaacgcaagcaaaatgcgttaggaaaatgtgatgcatgtctcagtgacaaagcacagttgcttctagaccaagaggctgaatcagcatcccaaaagatagaagatggtaaaacccctaagccactttctctgaaatctgataggtcaacaaacaatgtggagaggcatactccaaggaccaagattagacctgtaagtttgcctgtagatagactacttcttgcaagtcctcctaatgagagaaatggcagaaatatgggaaatgtaaatttagacaagttttgcaagaatcctgcctttgaaggagttaatagaaaagacgctgctactactgtttgttccaaatttaatggctttgaccagcaaactctacagaaaattcaggacaaacagtatgaacaaaacagcctaactgccaagactacaatgatcatgcccagtgcactccaggaaaaaggagtgacaacaagcctccagattagtggggaccattctatcaatgccactcaacccagtaagccatatgcagagccagtcaggtcagtgagagaggcatctgagagacggtcttcagattcctaccctctcgctcctgtcagagcacccagaacactgcagcctcaacattggacaacattttataaaccacatgctcccatcatcagtatcagggggaatgaggagaagccagcttcaccctcagcagcagtgcctcctggcacagatcacgatccccacggtctcgtggtgaagtcaatgccagacccagacaaagcatcagcttgtcctgggcaagcaactggtcaacctaaagaagactctgaggagcttggcttgcctgatgtgaatccaatgtgtcagagaccaaggctaaaacgaatgcaacagtttgaagacctcgaagatgaaattccacaatttgtgtagggatgtcaaatttcagggtttttttgttgttgttgtgttattttgtggtattgtgcttgttttgtgaaagaatgttttgacagggccccttttgtataggactgccaaatcatgggttttgccttttgttgttgtatttatcctctgttggtaatactgaatggtagaatgttttgatagggtcacatttgtgcctcactggaattatctttaaattctgtatttttaaagttgtgaataagataggtggattcgtattttttaaagttcagttgactttccccaccaaatggtccatttgaatgcatccctaatatatgatatagtctcaactaataggtgcaatttgggaaaatcaggtttattttttggagtggaactgttataagtgcttatttataaaaggaatgtttctgaatgcaagtgcctaaaaagatctttgttggtatgcatatgttttgtcacacaattttatagtgcatctttcaccatttgtgcttttttaagatacgtatgtaagctcttatttttcaattggcaattcagttaatttttaaatgtttacataatggccagaaggcttgcaaatctgtatttaattgcattttaattaattgccagtttttacatgtgatagtcagttgtacaaagaaaatgcacttaaacctgtttctaaattatatattcagttatattatatttggctttagatggttttaatacatttgatagtttttcaccccttggctttattttatataaacttttgtttttcagcagttctgaactttttagtattttataaatggtccaaaaaatgcctgtttcagaagtttttgaattcagtgcatttcctcttgatttgtctgggttaaaaccattccttttgtatgaaatgttttgacttaggaatcattttatgtacttgttctacctggattgtcaacaactgaaagtacatatttcatccaaatcaagctaaaatttatttaagttgattctgagagtacaggtcagtaagcctcattatttggaatttgagagaaggtataggtgatcggatctgtttcatttataaaaggtccagtttttaggactagtacattcctgttattttctgggttttatcattttgcctaaaataggatataaaagggacaaaaaataagtagactgtttttatgtgtgaattatatttctactaaatgtttttgtatgactgtgttatacttgataatatatatatatatatatatatcaacttgttaaattatttcatgttcccgtggcttcttttcagttgttgcctattacagtatgagagtttaaggttattaaccattggcttagaagtcaacacctaggatcatacatccgttgactacaatgtggaatgaattttatggaaacctgttttatagttctatgtgatgtaaaggtctagggagcaataaccagcccttttttttctgaaggcttgtttttagtcctcattgtacaaaatataaaataatcatattgctatgaatacctaaaaagaaaattagagcccatgtgtattgagccttctctgtgtgccaggaactttgccaaggtgctacatagattattttatttcaagttcacagcaacctataatgggtgggtaagcatgttattatttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcacctattcatctccagaacattatcatcatcctatactaaaacttagaaaatgtacttttaaacttcttcagttctcttttaatatatggagcccacccaaaggttatatcatgtaataaactcatttctctgttttccctcacagcttaaaaatgagaatttcacttttgggtcctttctgcctttagggctccctggcactttgtccagcgtagagccttaagcctctagatgctttctagtttcctggggccctgaggcaagtatctcttgagaagaggttgctatttctagaggatccacagtgtgcactgtgttgtgctatctaatagtgtggtggaaatcatttatccagaagt

SEQ ID NO: 454052 - DNA, 1351 bp, Homo sapiens
aggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaagctcctgtcccactgcctgctggtcaccctggccgcgcgcttccccgccgacttcacgccgaggcccacgccgcctgggacaagttctatcggtcgtatcctctgtcctgaccgagaagtaccgctgagcgccgctccgggacccccaggacaggctgcggcccctcccccgtcctggaggttccccagccccacttaccgcgtaatgcgccaataaaccaatgaacgaaaaatatatattcaatatcatatctcgtattcactaccaaatcggtggggtcccctttctaagtaatgatatctccctcggaaggtgcgccccatgttagcgcggtatacccgcactatttttctgttacaccaagggtggcgccccattatagagtcgcgctagcttatataataagaccgccgagctgccctcgttgccccactctagtattttcatccaagcaccccgtgcgtgcgaacaagttgcgcgaacagacgggctatacatctgatggcagcacccttgttgcgtgacagcagcgaccccctaaacatcatcggttgggtgggtggttgcacccatcaatctgtgggacacaccaattttccccattccacggaatgatactttctacagcagctccatcaatcggcccacaacacttctaacgaccttctgcaaacgcctgtaacaatcagcggctggtcgaaacaacactctcgcgcgccaatttagtactgctgcatcgactctggagaacacaactcatgatcccctcacagagtgactactgtggttgctccgtgagacaactgtcttttataccacggatgacc

SEQ ID NO: 454053 - DNA, 914 bp, Homo sapiens
aggagtgatagcccccaaaccccagtcccaccaggccctgagggcccctttgtcactggatctgataagaaacaccacccctgcagccccctcccctcacctgaccaatggccacagcctggctgggcccagctccctgtatataaggggaccctgggggctgagcactaccaaggccagtcctgagcaggcccaactccagtgcagctgcccaccctgccgccatgtctctgaccaagactgagaggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaacca

SEQ ID NO: 454054 - DNA, 529 bp, Homo sapiens
catgtctctgaccaagacttaggggaccatcattgtgtccatgtgggccaagatctccacgcaggccgacaccatcggcaccgagactctggagaggctcttcctcagccacccgcagaccaagacctacttcccgcacttcgacctgcacccggggtccgcgcagttgcgcgcgcacggctccaaggtggtggccgccgtgggcgacgcggtgaagagcatcgacgacatcggcggcgccctgtccaagctgagcgagctgcacgcctacatcctgcgcgtggacccggtcaacttcaagctcctgtcccactgcctgctggtcaccctggccgcgcgcttccccgccgacttcacggccgaggcccacgccgcctgggccaagttcctatcggtcgtatcctctgtcctgaccgagaagtaccgctgagcgccgcctccgggacccccaggacaggctgcggcccctcccctgcccttcaccctcccacagttcctgccctgactccaataaatggatgaggacgga

SEQ ID NO: 454055 - DNA, 502 bp, Homo sapiens
agagcacgtcaggcggcgccatgctcagcgcccaggagcgcgcccaaatcgcgcaggtctgggacctgattgcgggccacgaggcgcaattcggggcggagctgctgctcaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaacca

SEQ ID NO: 454056 - DNA, 443 bp, Homo sapiens
ggttcgggcctctgtttattgacaggcacagaccaaggcctgcgcagcacaaggctcttcacggtgtaccccagcaccaaggtctacttcccgcacctgagcgcctgccaggacgcgacgcagctgctgagccacgggcagcgcatgctggcggctgtgggcgcggcggtgcagcacgtggacaacctgcgcgccgcgctgagcccgctggcggacctgcacgcgctcgtgctgcgcgtggacccagccaactttccgctgctaatccagtgtttccacgtcgtgctggcctcccacctgcaggacgagttcaccgtgcaaatgcaagcggcgtgggacaagttcctgactggtgtggccgtggtgctgaccgaaaaataccgctgagccctgtgctgcgcaggccttggtctgtgcctgtcaataaacagaggcccgaacca

SEQ ID NO: 454057 - DNA, 683 bp, Homo sapiens
aactcctggtactctagcaccgatctgctttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtatctatgcatatatatttgta

SEQ ID NO: 454058 - DNA, 737 bp, Homo sapiens
tcccatgttaaatgcttaaaccgttcagggtttttgacccacacagttttgcaacgcaagctcaagtaactctttttaattatccaccgctacagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtatctatgcatatatatttgta

SEQ ID NO: 454059 - DNA, 918 bp, Homo sapiens
ttttataaataaaaaggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtaaaaatctgaggttttatctgagaaaaaggtggcaaagaaaatttcagtcttgaacagggtcagcagatagcacaatgtggtcagcctgcaaacccagagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtatctatgcatatatatttgta

SEQ ID NO: 454060 - DNA, 816 bp, Homo sapiens
ttttataaataaaaaggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatatagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtatctatgcatatatatttgta

SEQ ID NO: 454061 - DNA, 774 bp, Homo sapiens
tcccatgttaaatgcttaaaccgttcagggtttttgacccacacagttttgcaacgcaagctcaagtaactctttttaattatccaccgctacagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtgggactcgtgccgtctcgtcggctggcgcggggggtgcagcgcgattgtctctcgact

SEQ ID NO: 454062 - DNA, 778 bp, Homo sapiens
tcccatgttaaatgcttaaaccgttcagggtttttgacccacacagttttgcaacgcaagctcaagtaactctttttaattatccaccgctacagatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtcatgtacgcgtgccagctctcctctcccccatctttttattgtgcgagacggctgatagagt

SEQ ID NO: 454063 - DNA, 929 bp, Homo sapiens
ttttataaataaaaaggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtgccaagagcctgcaatccttcccaaacagccctttgttctgtgctcaagtcaacccactgggactttactacagataatgataagagaaatggcttgtgagattgctcatgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtatctatgcatatatatttgta

SEQ ID NO: 454064 - DNA, 970 bp, Homo sapiens
ttttataaataaaaaggctgtagtacacatccttgatggcaccaagtagcaaacgtgctgtggagactagatctcactctcaaatctgtcctgggatgcaagtgcctctacgaatgtggtgcagaagctacaaatgtggtgcagaagacagcttcaaagaggaaaggaatataggtgccaagagcctgcaatccttcccaaacagccctttgttctgtgctcaagtcaacccactgggactttactacagataatgataagagaaatggcttgtgagattgctcatgatcctgagactccagcaggatgtcttatcaacagcagcagtgcaagcagccctgccagccacctcctgtgtgccccacgccaaagtgcccagagccatgtccacccccgaagtgccctgagccctgcccatcaccaaagtgtccacagccctgcccacctcagcagtgccagcagaaatatcctcctgtgacaccttccccaccctgccagccaaagtgtccacccaagagcaagtaacagcttcaggattcatcaggagcatgagaggataaggataattggctcacctcgttccacagctccacttgcatcttctcaccaaagccttccatggatgcacagggagcttctttctccttaacctgtggcctgcctgtgatgatctgtgacagcaaaagattccctttctgaggctgccatactgccactgtccaggtggagctaagaaaaggaagtcctcagctgtgccagctcccagagcttcagcagaaagagcagcagctctctccctgggaaccatcagacaattctgttgatgtgttctgtgtctgtctgtcacctggtcatgagcttctaccacctttgcaattgtcatttatcgttcactccctgaataaagtcatgtacgcgtgccagctctcctctcccccatctttttattgtgcgagacggctgatagagt

SEQ ID NO: 454065 - DNA, 6603 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcactta

SEQ ID NO: 454066 - DNA, 1326 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaaggtacgggcgtgccgggccacctgcgccgggaggcgcgggtctttgggggtgggggtgggggtgggggggtccctccgatttccgccgagagaacttcccagcccatccagccgcatctgcaaactcaggagtgcgaacccctctttggaggcttttcagggtctttcgcgccggggcggggccagagcagcggcgagcgcggcggggggcttgcatctttgtcgcgggtctccaggggaggcgactgcgccatgcgcaataataaaacccgcgccctgcccacggcggctgagcctttctgcgcactcttccggtgggagccatgcagcccgaggcggaggagctgcgcggagggggatccgtggagaatggaccccgggccgggcctccggagctccgagatgcggaaagtcagctgtgaggccaggactcgtggtggagcccgccggggagcccagccaccctcgggttccccgtcgcgtaccgccctggatgccagcggtgcctggagcgagcgggtttggtacccagtcctcctgcggcagcggcccgagcaggcaccgccttcccgaggcagagaaagcctggggtgtagctcgctcagagccaggaaaaacctgggcaggcgctgcgtttccagaaggaatgacaggtttcgcaaaccagccagcgccctcgcgttcgctcagcgctttgcctgcagactcagttggccaaacacacgctagagtggctagaagttctcaaaggatggggtcagtgtaacgagcattccgggtactcttccctggacgcagtgctgaaacgactgcattttatcggcttcagtcttcaaggctggaatatttcttgtgggccaggacagccgccaagactgtggcttgttctggtcgtggtattttagatctattttccagcgcatgtgttcattagcaaggcttcactctactgattttgtgatacccttgtatca

SEQ ID NO: 454067 - DNA, 8383 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttttgagacagagtttcgctcttgttgcccaggctggagtgcaatggcccgatctcagctcaccgcaacctccacctcccggattccagcgattctcctgcctcagcctacattaagggttttgtcagacaattgtcacacgaagaatagtgtcacttatctgctcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataatttttttttttttttttgtttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtccaagacaatatttgattcctagttctgtttggggcaaattttcatttatctaaataaaatgcaatctaattaaatgccatggattttctttctgta

SEQ ID NO: 454068 - DNA, 4168 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagcaggaatggctgaactgtttcaagaagcagaactgggtccgcc

SEQ ID NO: 454069 - DNA, 1164 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagagggtaagccgcccctccaggaactggaaggcacacagcacttgcaacaaactttggactcagcagaaaatactctgtcatactgcctggtggtggattggtgttaacagcaaaaacaatcaattggttacaaaaggaagtatttatctgaccatttggataccccctatacttagaccttgaagttatgtttcctttttcttatctggaacttgatgctttttaaattattgttgctttgtcccaactgcttgtctggagttgaatgtgaattcttgttggaaacagaagtcatggttgctttaaaagagtcattatctctccctctagagaggagcctgctatacttgtacaactctttctgataggcgcattgcaaggcacgtacccctctttgcttaaactatgatgtgctgcgtgttttatagctcttgagcctagagatcttcgaggaatggttattgaagagtgaccgtttggacacagtattgggatttgatttttacccatatagggggtgaggaaccgtatcttgaggtcagaattgagagcatgtggcccagtaagtctcttgtgaaaagcgaaaggctgcatgttgaagaaggaccttgagctcgttgttccatttaattataaataaagggataaccaataact

SEQ ID NO: 454070 - DNA, 6447 bp, Homo sapiens
tgcggcccgggcggggaagtttgcgctcccgaagtcctggagctcagcaagggaggggccagcgccagcccgcgtgtgggtggctgggtgggggcgtgggtgggggtccgcctataattatctggggaaatgcatccgcgctctgcttttcgctgcggcagctccgagggcacctccggttctcccccatcctccgggagtgtctgggcgctcagtccgctctgatcccgccgaaaccacctgcggttggcaggcaggagactaggcgtctgccggggagggcagggacccgctaagctgatctcctgtacagtagtgctacttaaaatatgctggggaccatcaccatcacagttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcactta

SEQ ID NO: 454071 - DNA, 7112 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttttgagacagagtttcgctcttgttgcccaggctggagtgcaccactacactccagcctggatgacagagtgagacttcatctca

SEQ ID NO: 454072 - DNA, 3925 bp, Homo sapiens
ccttcttttaaggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcgaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagccgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagca

SEQ ID NO: 454073 - DNA, 730 bp, Homo sapiens
gctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcaggtaagcttccttgtcttctaagataatttttctcttttatgccaatagatggcaaatttgttacataaggaatcgggagcaaataattaatgccttcgtgtagaaccttcagttgaggaaaataactatcaactagattcaaagatctaggatagtttcatggtttttggtgattgaaatgccatttagtcttatcgatgttatgaaaagaacgacttcgttttacctcctaatgtgactgctttagaataaaataaaacggcatgtgtgtgtgcacatgtgcgtgtttgacccaaaggcataagaaatacattgtgttcactcaactatcttgttgagtttttttaaaaataactagtgctccaatggctgggcg

SEQ ID NO: 454074 - DNA, 3833 bp, Homo sapiens
ggcacgagggtcttcccctcgtgggccctgagcgggactgcagccagccccctggggcgccagctttggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454075 - DNA, 4354 bp, Homo sapiens
attataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctggtgaatttgaccattaaaaaaaatgtttgttggcaatttggctttgcttttctgtgaaatgactattcacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggagaaatggggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454076 - DNA, 4372 bp, Homo sapiens
attataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctggtgaatttgaccattaaaaaaaatgtttgttggcaatttggctttgcttttctgtgaaatgactattcacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggagaaatggggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454077 - DNA, 3856 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454078 - DNA, 3968 bp, Homo sapiens
gaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454079 - DNA, 3810 bp, Homo sapiens
ggcctgggagcgcccaggcgggcttggcgggcgggttacctgggggaggccgggccgggcgctagcgcgcggggtcggacgcctgggtctgccgggaagagcgatgagaggtgtctgaaggtggctattcactgagcgatggggttggacttgaaggaatgccaagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454080 - DNA, 3795 bp, Homo sapiens
gaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454081 - DNA, 3911 bp, Homo sapiens
gaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggcccccgacagctgctctcgggagccgcctcccgacacccgagccccgccggcgcctcccgctcccggctcccggctcctggctccctccgcctcccccgcccctcgcccgcggaagcgccgtcgggtgtctgcgaaggaaagatgtgccctagccagaagcgaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454082 - DNA, 4207 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaacaacaagacaaaacacaaacaataacacgaacgaaagcaaacacaacgcaaacaagacgaaccagcacaacaacacaccaaccaacaaaaagaacaaaaagaagaaaacgaaccgccgggcggagccacggaaacacaaccacgagacaacagacacgacaagcgaaaagagaaagcgacagacggcgacggaaaaaaaggggcggcgcgcaccagaaacggcagaaagccacccgccggcgacggggggaaccccccaggggggacacggacccccccagaaaagaaccgacggacaaacgacgcacgggcacacgagcagggggaaaaggcacgcgaccaacc

SEQ ID NO: 454083 - DNA, 2560 bp, Homo sapiens
  misc_feature (4)..(4): n is a, c, g, or t
  misc_feature (34)..(34): n is a, c, g, or t
  misc_feature (43)..(43): n is a, c, g, or t
agcngcccctactactactaaattcgcggccgcncgaccgcgnaggcctgggagtgcatcctcatggggaagttcacgactgcgagtgacgtgtgggcctttggtgtgaccctgtgtgaggtgctgatgctctgtagggcccagcctattgcgagcgtcaccgacgagcaggtcatcgagaacgcgggggagttcttccgggaccagggagcggagtggggcggattcccacgaggccggggctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454084 - DNA, 5061 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaactgtgtgagtgggttccttgggaatttggtaactctgcctcctgcacctccctctgaacccacttcccaacccacttcccatcttccttttttcctgcctcctcattccatttcccatcacctgttttgcccagcattgtgttctgtttctggataatccaggcctttgcctgtgggacctcaggagatgcatgaatgtctgagtgcatgaaccttctcaactcagaggggtgctctggtggaggcctggaaggaatgcagtcaggccaggggtgctgaaccttttttgtgccataaacgcctttggcagtctgtagaggtctactgagtcctcctcagaattaggttttaaaacctataaaatggaccaggcatagtggctcacccctgtaatcccagcactttgggaggctgaggtgggtagatcacttgaggccaggagttcgagaccaacctggccaacatagcaaaaccccatctctactaaagatacaaaaattagcagggtgtggtggcatgcgcctgtaatctcagctattcaggaggctgaggcaggagaattgcttagaacccgggaggtgggggttgcagtgagctgagatcacacaactgtgctccagcctgggcaacagagtgagactgtctcaaaaacagaacaacaacaacaacaaaacccataaaatgtataggattataagggaaaccaatggaaacagtttaccaaaatgctaaaaaattatgaaactaatgtgcttctttttcatgtatttaataacaagatctaaaaacaggtgtaataaactgacattttccaaataaataagagagagagaaatgaaaatagagaaaggagaaaaaggggggggggataaaagattcccggggagggggccgcaggttgatcgggttactccacgattttgttgtggtcgcaagggtgggtcccataatggaggagacgagtgattgtaaagcatagagcatgtggccggccgtctttttaaacaacgttcgagaatcgtgggcaaagaagggtggtttaccgtgggggaaaatctttggcgtataaggcacacctgtatactatcggtgggggtggggtaccactacagtgtgtggcagaagagtaatagcgctaacaggagagaattgaaagagggttctgaggggttaaccttgtttcacaattgttggaaggcggctta

SEQ ID NO: 454085 - DNA, 2903 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454086 - DNA, 2204 bp, Homo sapiens
  misc_feature (4)..(4): n is a, c, g, or t
  misc_feature (34)..(34): n is a, c, g, or t
  misc_feature (43)..(43): n is a, c, g, or t
agcngcccctactactactaaattcgcggccgcncgaccgcgnaggcctgggagtgcatcctcatggggaagttcacgactgcgagtgacgtgtgggcctttggtgtgaccctgtgtgaggtgctgatgctctgtagggcccagcctattgcgagcgtcaccgacgagcaggtcatcgagaacgcgggggagttcttccgggaccagggagcggagtggggcggattcccacgaggccggggctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454087 - DNA, 3620 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454088 - DNA, 1425 bp, Homo sapiens
  misc_feature (5)..(5): n is a, c, g, or t
  misc_feature (25)..(25): n is a, c, g, or t
  misc_feature (27)..(27): n is a, c, g, or t
acatnaggctagtagaggctgggtntnaatcggccgaggctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454089 - DNA, 3257 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccggctagtcggggggatcctacaagtcacctaa

SEQ ID NO: 454090 - DNA, 919 bp, Homo sapiens
ccccgactagcccgacaggaccatacaggacaaccatagtgcatcctcatggggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454091 - DNA, 877 bp, Homo sapiens
  misc_feature (4)..(4): n is a, c, g, or t
  misc_feature (34)..(34): n is a, c, g, or t
  misc_feature (43)..(43): n is a, c, g, or t
agcngcccctactactactaaattcgcggccgcncgaccgcgnagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454092 - DNA, 786 bp, Homo sapiens
gtgtaccgggatactagtacagatcgaccgtaagcttgaatagagggagtgggactgtcgtgtggacaaggttcgctgccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454093 - DNA, 3543 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggactaggcaggtaataataaaggttgagttttccacaactgtgtgagtgggttccttgggaatttggtaactctgcctcctgcacctccctctgaacccacttcccaacccacttcccatcttccttttttcctgcctcctcattccatttcccatcacctgttttgcccagcattgtgttctgtttctggataatccaggcctttgcctgtgggacctcaggagatgcatgaatgtctgagtgcatgaaccttctcaactcagaggggtgctctggtggaggcctggaaggaatgcagtcaggccaggggtgctgaaccttttttgtgccataaacgcctttggcagtctgtagaggtctactgagtcctcctcagaattaggttttaaaacctataaaatggaccaggcatagtggctcacccctgtaatcccagcactttgggaggctgaggtgggtagatcacttgaggccaggagttcgagaccaacctggccaacatagcaaaaccccatctctactaaagatacaaaaattagcagggtgtggtggcatgcgcctgtaatctcagctattcaggaggctgaggcaggagaattgcttagaacccgggaggtgggggttgcagtgagctgagatcacacaactgtgctccagcctgggcaacagagtgagactgtctcaaaaacagaacaacaacaacaacaaaacccataaaatgtataggattataagggaaaccaatggaaacagtttaccaaaatgctaaaaaattatgaaactaatgtgcttctttttcatgtatttaataacaagatctaaaaacaggtgtaataaactgacattttccaaataaataagagagagagaaatgaaaatagagaaaggagaaaaaggggggggggataaaagattcccggggagggggccgcaggttgatcgggttactccacgattttgttgtggtcgcaagggtgggtcccataatggaggagacgagtgattgtaaagcatagagcatgtggccggccgtctttttaaacaacgttcgagaatcgtgggcaaagaagggtggtttaccgtgggggaaaatctttggcgtataaggcacacctgtatactatcggtgggggtggggtaccactacagtgtgtggcagaagagtaatagcgctaacaggagagaattgaaagagggttctgaggggttaaccttgtttcacaattgttggaaggcggctta

SEQ ID NO: 454094 - DNA, 1802 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtaagacctgccttgttccagtcgcacctctgtcc

SEQ ID NO: 454095 - DNA, 1200 bp, Homo sapiens
  misc_feature (1006)..(1006): n is a, c, g, or t
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccaactggccgaggtggtggagtccgggagtcctgcagagaccttgctgctggccctcctggatgncaccaggtagaggccgacctgacattctttaacacgctggtgagaaagaagagcaagctgtgagacctggagggggccaaggcgctgttgccggtcctggcaaagaggggcctcgtccccaacctgcagacattctgcaacctggccatcgggtgccacaggccgaaaggacgtctacagcttctcacagacat

SEQ ID NO: 454096 - DNA, 339 bp, Homo sapiens
ttcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgcttacccaggctgggccttgctcagaattcccccaggggatctcctcctctcccctcgcttcagcctggaggaaaagaggggagcgtgggggtgggaagggagagaggttccaggagggcctgggataaggaatgtgtgacaagttaacccaggaacatggacagaaag

SEQ ID NO: 454097 - DNA, 4243 bp, Homo sapiens
attataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctggtgaatttgaccattaaaaaaaatgtttgttggcaatttggctttgcttttctgtgaaatgactattcacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggagaaatggggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454098 - DNA, 409 bp, Homo sapiens
aatagagttgggtgccatggtgtggtgaatgggctgagggactagggtgtccccaatgggggaccgttgtccagaaacaggttagattctctctttggtcctcatgtcaccatctgtcccgcaggtgcctcttcctttctcagccttttatacttctcatctccccgtgtcccttagcttcacactctgcgccccagtctccctcctctttccctccactctctgtttcactccagcccctccttcccttgtccttgcttcttgtccccttgatctgtctgcccagctctcgagcctcctcagttccctgccttcctctcttaggagtttgtttccaacactgtttccttcccgagtccacttcagttccttcatccagttcagcccttttcttcccaaacttcagtct

SEQ ID NO: 454099 - DNA, 3897 bp, Homo sapiens
aatagagttgggtgccatggtgtggtgaatgggctgagggactagggtgtccccaatgggggaccgttgtccagaaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454100 - DNA, 3745 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454101 - DNA, 3780 bp, Homo sapiens
aatgtcactgccggtgagcgccagcttcagggtcccacccccccatgcctggctcttggctgaacatttcttcccagcgcttccagcagccagaggcaggcgcccaagctcgctggctgttgctgagggcctgtagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454102 - DNA, 3233 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454103 - DNA, 3418 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtcctagagagccacccccgtaccaggagccccggcctcgtgggaatccgccccactccgctccctgtgtccccaatggctctggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454104 - DNA, 1899 bp, Homo sapiens
  misc_feature (5)..(5): n is a, c, g, or t
  misc_feature (25)..(25): n is a, c, g, or t
  misc_feature (27)..(27): n is a, c, g, or t
acatnaggctagtagaggctgggtntnaatcggccgaggcgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454105 - DNA, 4795 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaactgtgtgagtgggttccttgggaatttggtaactctgcctcctgcacctccctctgaacccacttcccaacccacttcccatcttccttttttcctgcctcctcattccatttcccatcacctgttttgcccacactttgggaggctgaggtgggtagatcacttgaggccaggagttcgagaccaacctggccaacatagcaaaaccccatctctactaaagatacaaaaattagcagggtgtggtggcatgcgcctgtaatctcagctattcaggaggctgaggcaggagaattgcttagaacccgggaggtgggggttgcagtgagctgagatcacacaactgtgctccagcctgggcaacagagtgagactgtctcaaaaacagaacaacaacaacaacaaaacccataaaatgtataggattataagggaaaccaatggaaacagtttaccaaaatgctaaaaaattatgaaactaatgtgcttctttttcatgtatttaataacaagatctaaaaacaggtgtaataaactgacattttccaaataaataagagagagagaaatgaaaatagagaaaggagaaaaaggggggggggataaaagattcccggggagggggccgcaggttgatcgggttactccacgattttgttgtggtcgcaagggtgggtcccataatggaggagacgagtgattgtaaagcatagagcatgtggccggccgtctttttaaacaacgttcgagaatcgtgggcaaagaagggtggtttaccgtgggggaaaatctttggcgtataaggcacacctgtatactatcggtgggggtggggtaccactacagtgtgtggcagaagagtaatagcgctaacaggagagaattgaaagagggttctgaggggttaaccttgtttcacaattgttggaaggcggctta

SEQ ID NO: 454106 - DNA, 4252 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaagaaagcaagagaagtcagtgcaacagaagaagcggggggcggcgagaataaagaagactcagtcgctgcagggggagcaccgtcataactaaggtaagcaccacgctgatgtggtaagcacgggcggggccccgatacctgcagactgatggaattacgaatggagacggggacgcctggctgcatacacatcctggcagaccgggacacccatggctacagcgagcgaagacgttgagagaggcgaccagtcctctgcgggggggaggacagtatgggaagacacctgggaccaaagaatgtaggacgcggaggcaaaaaagactaaggggtgcagggaaccacaggaaattgcgccaaaaaaggcacgcaaagggcagagaactatacgg

SEQ ID NO: 454107 - DNA, 3441 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcgggctagtcggtaagatcctgtagatcacccg

SEQ ID NO: 454108 - DNA, 3433 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcgttgctgctctccaatccagcctaccgcctccttctggccacttacgcccgtccccctcgaggcccgggcccccccacacccgcctgggccaaacccaccaacacccaggcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacattctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454109 - DNA, 1386 bp, Homo sapiens
cccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccactcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaa

SEQ ID NO: 454110 - DNA, 3119 bp, Homo sapiens
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctga

SEQ ID NO: 454111 - DNA, 2022 bp, Homo sapiens
agcgaaggaatttcgcagagctgaagatcaagcgcctgagaaagaagtttgcccaaaagatgcttcgaaaggcaaggaggaagcttatctatgaaaaagcaaagcactatcacaaggaatatattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctga

SEQ ID NO: 454112 - DNA, 400 bp, Homo sapiens
cggtattgagaaatgcccggcatgctcggctttgtgtgtttaaaatcgttttatcttctgtttcagagatttcatctttactaattgggttgcgggggcttttgtttataaatttcactgtaggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctga

SEQ ID NO: 454113 - DNA, 12715 bp, Homo sapiens
  misc_feature (7934)..(7934): n is a, c, g, or t
  misc_feature (7956)..(7956): n is a, c, g, or t
  misc_feature (8012)..(8012): n is a, c, g, or t
  misc_feature (9393)..(9393): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454114 - DNA, 12661 bp, Homo sapiens
  misc_feature (7880)..(7880): n is a, c, g, or t
  misc_feature (7902)..(7902): n is a, c, g, or t
  misc_feature (7958)..(7958): n is a, c, g, or t
  misc_feature (9339)..(9339): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454115 - DNA, 12758 bp, Homo sapiens
  misc_feature (7977)..(7977): n is a, c, g, or t
  misc_feature (7999)..(7999): n is a, c, g, or t
  misc_feature (8055)..(8055): n is a, c, g, or t
  misc_feature (9436)..(9436): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggtacagtactcagaagcttactgagctgattttacagttttatggcatcagagcagacatgaagagggaaagcaaacatgccaggatgtctatgaaagaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454116 - DNA, 12685 bp, Homo sapiens
  misc_feature (7904)..(7904): n is a, c, g, or t
  misc_feature (7926)..(7926): n is a, c, g, or t
  misc_feature (7982)..(7982): n is a, c, g, or t
  misc_feature (9363)..(9363): n is a, c, g, or t
gggttggggacccctgttgtaaggtttaaagatgaatggaaacaaagtgtccgggacgcagtgagtgcttggcggatggcagtcgcccttggcagtgaaagatctttgctaagaagcctctttggttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454117 - DNA, 12662 bp, Homo sapiens
  misc_feature (7934)..(7934): n is a, c, g, or t
  misc_feature (7956)..(7956): n is a, c, g, or t
  misc_feature (8012)..(8012): n is a, c, g, or t
  misc_feature (9393)..(9393): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcgatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454118 - DNA, 12235 bp, Homo sapiens
  misc_feature (7934)..(7934): n is a, c, g, or t
  misc_feature (7956)..(7956): n is a, c, g, or t
  misc_feature (8012)..(8012): n is a, c, g, or t
  misc_feature (9393)..(9393): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgattgtcataccatattgaatggttgtgaccattgttattttggggaatctgct

SEQ ID NO: 454119 - DNA, 9651 bp, Homo sapiens
  misc_feature (6329)..(6329): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454120 - DNA, 8578 bp, Homo sapiens
  misc_feature (5256)..(5256): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctggagcacttaaggattgttgactcccaagcccagcagtgtgttatggttacatgtcctttctcctccaaatgtccccattaatttgctattctctctctttactttttttttttttttggtgtggcacattctttaataacttcgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454121 - DNA, 3262 bp, Homo sapiens
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggtacagtactcagaagcttactgagctgattttacagttttatggcatcagagcagacatgaagagggaaagcaaacatgccaggatgtctatgaaagtatttcttgctgtcggagaactgttggcctggcctaatgttgctgaattgctggaaacctgcccatttaaaacataggaaaccagaaaaacgtctcaaattcttacaattctgagacgtccccattcctgttgaagtcatagagttgctttattatgtttttatttttaaaaaattttatttactcgccacagatttgaattggcttggaaggatttagattactggaatcggaagcctctgtctgaatat

SEQ ID NO: 454122 - DNA, 10057 bp, Homo sapiens
  misc_feature (5276)..(5276): n is a, c, g, or t
  misc_feature (5298)..(5298): n is a, c, g, or t
  misc_feature (5354)..(5354): n is a, c, g, or t
  misc_feature (6735)..(6735): n is a, c, g, or t
ccttatcattaagcacagtccgatcggatatccggtttgggcaataagagatgtaaataaagtgaggattttaaagcccaaaggcctccttgctataaaaacgcacccaaaacgcctcacctggaccccgcgcgcacccagaaggatcacgttcagagacagaggtgcaacatgagtcaagagatttcatctttactaattgggttgcgggggcttttgtttataaatttcactgtaggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454123 - DNA, 168 bp, Homo sapiens
gacacctcgctttaagttcataaattgcttccctccaggtaaaactggttagcattgatgcagcagaaatagcagatggcaacccttctttggttcttgggctgatatggaacataatcctcttcttccaggtaagatcatttcttttccaaaacacacaatcatgat

SEQ ID NO: 454124 - DNA, 382 bp, Homo sapiens
tcagtcactcaaggtcacagagctgactcagccaggatttgaaatcagatcttgccaactctagaacctatattgttttaactccatcaatttgtagcatttgaagtctgtaccaggggccggagttggggtggacttgtctctcatgcaggctgtgctgcaggggattcatgaagaggatcagggaacaggcagaattggaagggacgccctggctgggcctgggcagagcactgctgggtgatgtcacctactttacactgcagcgtgacatactgacttggatttggttgttctgtctttcagtcccaggaatccccaaacctggaaaacatagcaaaccccctagaagaaaatgtaacgaaagaatcaatcagtagta

SEQ ID NO: 454125 - DNA, 11564 bp, Homo sapiens
  misc_feature (6783)..(6783): n is a, c, g, or t
  misc_feature (6805)..(6805): n is a, c, g, or t
  misc_feature (6861)..(6861): n is a, c, g, or t
  misc_feature (8242)..(8242): n is a, c, g, or t
agcgaaggaatttcgcagagctgaagatcaagcgcctgagaaagaagtttgcccaaaagatgcttcgaaaggcaaggaggaagcttatctatgaaaaagcaaagcactatcacaaggaatatattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454126 - DNA, 11442 bp, Homo sapiens
  misc_feature (6661)..(6661): n is a, c, g, or t
  misc_feature (6683)..(6683): n is a, c, g, or t
  misc_feature (6739)..(6739): n is a, c, g, or t
  misc_feature (8120)..(8120): n is a, c, g, or t
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcatcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggtacagtactcagaagcttactgagctgattttacagttttatggcatcagagcagacatgaagagggaaagcaaacatgccaggatgtctatgaaagaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454127 - DNA, 9822 bp, Homo sapiens
  misc_feature (5041)..(5041): n is a, c, g, or t
  misc_feature (5063)..(5063): n is a, c, g, or t
  misc_feature (5119)..(5119): n is a, c, g, or t
  misc_feature (6500)..(6500): n is a, c, g, or t
gggtagcactgggtggggtccactttcctgggaacctgcttggtaactgcgtttcctctgtgtttcttctgtaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaaaaggggcggggttacttcattttattttgggttctgggtggggcacttctacagacagttgaggacctccgaggaaacttagaccccctttctcgctattgtggttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccagaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatncacttatagtcccagctactcnggaggatgaggcaggagaattgtttgagcccatgactttgaggttactgtgagctntgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttgganaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccgagtggctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgcataatttatacctgtgggaattaactggagtatttgttatttgactgttttctattaaggaatattaggcttggtgctatgatgaatgatcttgtaaaatcatgtgtattcttaagaaaatttttgaatataaatttcttgaactgaaaaaaacgtt

SEQ ID NO: 454128 - DNA, 3844 bp, Homo sapiens
  misc_feature (1128)..(1128): n is a, c, g, or t
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacacgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcngagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggcccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctctccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtcaaaaaaaa

SEQ ID NO: 454129 - DNA, 3408 bp, Homo sapiens
  misc_feature (1128)..(1128): n is a, c, g, or t
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacacgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcngagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggagagcgctgctctggctgataggttaatccaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctctccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtcaaaaaaaa

SEQ ID NO: 454130 - DNA, 1914 bp, Homo sapiens
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatgtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctctccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtcaaaaaaaa

SEQ ID NO: 454131 - DNA, 1364 bp, Homo sapiens
  misc_feature (1128)..(1128): n is a, c, g, or t
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacacgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcngagctgatgcagctggacatggaggggatgtcccaggcttttaaatcattgggattatatgaatgagccaccacatccagcatctgccagcttttcttctggaaactaaggctttggctgcaggcagtcccccattccctcccctcacgctcagtctttccattgctccacaaacactgaggacacggcgttgaggacatggcgacaccccgggcagacccgttcctgcccccctc

SEQ ID NO: 454132 - DNA, 472 bp, Homo sapiens
tacacccattttatagctgaggaactccaaccgggttccacaggcgagtccgctccccgtgggccttgtcaagggggtcgccctcccccatctgagccgcccaaggcagagctcaggaggaaacgtggctgggggcgtttgtcctgcaggaagggccatgcggctgcgctgctcccccaggccctgaccccactcttcccgcagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggtgagggccgggtgggcgccggcgggcagagcgccccctagggccatcccctcggggttcttgggcggaggctgaccgccggcttctcggcttcaccccccaggcccatctggcccgcggcggccgc

SEQ ID NO: 454133 - DNA, 3375 bp, Homo sapiens
  misc_feature (1128)..(1128): n is a, c, g, or t
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacacgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcngagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctctccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctttcttcatgtgtttccagccccaccctcagccagagccaggcccccaggcaggagcttcccagcgagcggcctcccctcacttcctcctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtcaaaaaaaa

SEQ ID NO: 454134 - DNA, 3755 bp, Homo sapiens
  misc_feature (1128)..(1128): n is a, c, g, or t
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacacgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcngagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggagctgaaggcgctcaaggtgcgggaaggccaggcggtggcctcgacgcgagagcttaaactgcagctgcaggagctctcggacacctggcaggcccatctggcccgcggcggccgctggaaggagtccccacggaagctggtcgtgggcgagctgcaggacgagctgatgagcgtgcgtctgcgcgaggcccaggccctggccgagggccgcgagctgcggcagcgcgtggtggaacttgagacgcaggaccacatccaccgcaaccttctgaaccgcgtggaggcggagcgcgcggcgctgcaggagaagctgcagtacctggctgcacagaacaaggggctgcagacgcagctcagcgaaagccgccgcaagcaggccgaggcccgagtgcaagagcaaggaggaggtgatggctgtgcgactgcgggaggcggacagcatggctgcggtggccgagatgcggcagcgcattgccgagctggagatccagagggaggaaggccgcatccagggccagctgaaccactcggactcatcgcagtacatccgcgagctcaaggaccagatcgaggagctgaaggccgaggtgcggctgctgaagggcccgccgcccttcgaggacccgctggctttcgatgggctgagcctggcgcggcacttggacgaggactcgctgccgtcgtcggacgaggagctacttggcgtaggcgtgggcgctgccctgcaggacgcattgtaccctctgtccccgcgcgatgcgcgcttcttccgccgtctggagcggccggccaaggacagcgagggcagctcagacagcgacgccgatgagctggccgcgccctacagccagggtctggacaactgaggccatgcccagcgcgcccggagtcaggaggccgcagccgcggggggcgcccgggcagtccgcgttctgctccccacctgccgcacttgacaaactacgcgccctctgtggctcggccacccctaaagcgaggcccggcgaggcagcgcagagggtagggtccgacctgggctcctcagggccccggggcaggctctctctccccagcagtgtttacccatcttggtctgtacccctccgggccctctggcgttccaggggtgcctggaggggctgactgctctcttaacaggagggcagagggcaggggacagacgacccagaggtcccagcactgaatgagcaggcagctcccacctcctggcaggcttccttctgggacaggggcgacattgctgggaagtgctcaggaggtagccgaggcctgaggaaggagagcgccagctctgggctggacatcagcaccccacaacactcctcgggatgaagtgacccttgactagcccctggccatctctaggggagtcaggccgctggggacagatggccaggccggcctctcctgcctggcgcaggcaccgtggcccctgcagcggaaaccaaagtccccctactatgtgcggggcgcctggggactgagtggctaacgggaagcctccctgcttctctggggccagagcagcttccaggaagtgaagagacccctctccccagtgccccacatctttctctgggagacactcgcgccccctatcctggccagtgatggaggggtatctctacaggggtcctcggtctccatctacttccctggtggtcccgttgtctctgctgaatcagagctgagaacggtgccaaaatccaacgatgccccccaggccccttcctcccttcccccggccccccgggcctcatgaccctgggggctgcccccctcggtgctcccggagcctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtcaaaaaaaa

SEQ ID NO: 454135 - DNA, 1939 bp, Homo sapiens
  misc_feature (1128)..(1128): n is a, c, g, or t
gcggccgcggtcccggggggcggctgagggggccgggccggggctgcggggcgaacggcgcggctaggatccggcggctcagcccggggcggcgaggctcggcacggagatggcggcgcgctcggcgcagacagagctgtgaaccaaccccgctcacggctaacaagcccacccaccatggcgagccccactctgagccccgactcctcatcccaggaggccctgtcggcccccacctgctccccaacctctgactccgagaacctcagccccgatgagctggagctgctggccaagctcgaagagcagaaccggctcctggaggccgactccaagtccatgcgctccatgaatggctcgcggcggaacagtggctcctcgctagtgtccagctcctcggcctcctccaacctgagccacctggaggaggacacgtggatcctgtggggccggatcgccaacgagtgggaggagtggcggcgcaggaaggagaagctgctcaaggagctgatccgcaagggcatcccccaccacttccgggccatcgtgtggcagcttctgtgcagcgccacggacatgcccgtcaagaaccagtactccgagctgctcaagatgtcctcgccgtgcgagaagctgatccgcagggacatcgcccgcacctacccggaacacgagttcttcaagggccaggacagcctgggccaggaggtcctcttcaacgtcatgaaggcatactcgctggtagaccgggaggtgggctactgccagggaagcgccttcatcgtgggcctgctcctcatgcagatgcctgaggaggaggccttctgtgtgttcgtgcggctgatgcaggagtaccggctgcgggagctcttcaaacccagcatggccgagctcgggctctgcatctatcagttcgagtacatgctgcaggagcagctcccagacctcaacacccacttccgttcccaaagcttccacacatccatgtatgcctcgtcctggttcctcacactgttcctgaccaccttcccactccccgtcgccacccgggtctttgacatcttcatgtatgaggggctggagatcgtgttccgagtgggcctcgccctgctgcaggtgaaccaggcngagctgatgcagctggacatggaggggatgtcccagtacttccagagagtgatcccccaccagttcgacagctgcccggacaagctggtcctcaaagcctaccaggtcaagtacaaccccaagaagatgaagaggctggagaaggagtacgcagccatgaagagcaaggagatggaggagcagatcgagatcaaaagacttcggacggagaaccggctcctgaaacagcggattgaaaccctagagaaggggcaagtgacacgggcgcaggaggcggaggagaactacgtcatcaagcgggagctggcggtggtgcggcagcagtgcagctcggcggccgaggacctgcagaaggcacagagcaccatccggcagctacaggagcagcaggagaacccccgcctcacagaagacttcgtgtcccacctggagaccgagctggagcagtcgaggctgcgggagacggagacactgggggcccttcgggagatgcaggacaaggttctcgacatggaaaagaggaacagctcgctgcccgacgagaacaatgtggcgcagctgcaggaggacctccagtagagtagcgtcacaagcaatctccctggcgcttcctgggtggggacccctgctccgtccccgcttcctagctgcccacttttcagtgttacgaagcctggggaccggggcaggcacccacggggctctccacacgccccctacactgcccgccaccattttgcacactgcctgttcacatgtcgcccaggcgggaaaaatggaaaataaagtgtatttacacagtcaaaaaaaa

SEQ ID NO: 454136 - DNA, 3757 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattaaccagcttcagcagattatgcgtctgacaggaacaccccccgcttatctcattaacaggatgccaagccatgaggcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaa

SEQ ID NO: 454137 - DNA, 1316 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctgggtaagttgaccatatatcctcacctcatggatattgaattggttatgatataaattggggatttgaagaagagtttctccttttgaccaaataaagtaccattagttga

SEQ ID NO: 454138 - DNA, 3703 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggttttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaa

SEQ ID NO: 454139 - DNA, 4240 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgaggccaaatctggcccaccacctgtttggtgtagcctgctaagaatggcttttacatttttaaatggttgggaaagaaaaaaaaaaaagaagtagtagattttgtagcatgtgatgtaagtaatgtaaaacttaaattccagtatccataaataaagttttatgagaacaga

SEQ ID NO: 454140 - DNA, 4223 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaaagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaatttagtgagtttctcaagtttattatatttttctcttgtttttatttaatgcacaatatggcattatatcaatatcctttaaactgtgacctggcatacttgtctgacagatcttaatactactcctaacatttagaaaatgttgataaagcttcttagttgtacattttttggtgaagagtatccaggtctttgctgtggatgggtaaagcaaagagcaaatgaacgaagtattaagcattggggcctgtcttatctacactcgagtgtaagagtggccgaaatgacagggctcagcagactgtggcctgaggccaaatctggcccaccacctgtttggtgtagcctgctaagaatggcttttacatttttaaatggttgggaaagaaaaaaaaaaaagaagtagtagattttgtagcatgtgatgtaagtaatgtaaaacttaaattccagtatccataaataaagttttatgagaacaga

SEQ ID NO: 454141 - DNA, 3597 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggagtaggaggattcaggaggaggagaattcgccagagcaggagattcgcccgggtcctctagat

SEQ ID NO: 454142 - DNA, 1974 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtcccgcaaaaaaaaaaagaattcacaaagaacaccgcaaacaaaaaacgccgggggccaatatgggggggcgggaaacacgggtttagcagggggcggggcacagggttttccggcccccctttggtgcaagggggggaagggggggcccaaagggggggaaaatcgaaccggacccgt

SEQ ID NO: 454143 - DNA, 498 bp, Homo sapiens
tagcttgtgagagtgctctttcattcttgagcacctccgtagagagcttaaaagaagaggcactcagcgatgaaaaacatgagaaaaaaaatggttcttttctatgtcccttgaacttctgtgtgataacgtgttccagtaggctattacatacaagctgtgaggtagcccatcaaaccactacctggacagagaggaaggatcttgagcttagaagtcagagtgcttgccagcaaagagaatagcctaaactctcacatcttacttttccttcccaatttctaggcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgtt

SEQ ID NO: 454144 - DNA, 3757 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaa

SEQ ID NO: 454145 - DNA, 3685 bp, Homo sapiens
ggaattccgggcccggtctttcctcccgccgccgccggcctggtcccggggactggcctccacgtccgactcgtccgagctgaagcccagcagcactttgctgccagccgcgggggcggcggaggcgcccccgggccctcccaggaggctctctgggccagaggccgagattcggcacaggcccccaggagtccgtaagtaggagaggtcgcccgagaccggccggacccccatccccgcggccgccgccgccgctggtcccgcggctgcgaccgtggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaa

SEQ ID NO: 454146 - DNA, 4302 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattttatcagccatgtttggttgtaaatgctcgtgtgatttcctacagaaatactgctctgaatattttgtaataaaggtctttgcacatgtgaccacatacgtgttaggaggctgcatgctctggaagcctggactctaagctggagctcttggaagagctcttcggtttctgagcataatgctcccatctcctgatttctctgaacagaaaacaaaagagagaatgagggaaattgctattttatttgtattcatgaacttggctgtaatcagttatgccgtataggatgtcagacaataccactggttaaaataaagcctatttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaagagagggggggggcgggaaaccggggggggcaaaaacagaagcacaccaacaacaggatattaagagagaagaagagaggcgccacacaaagagaagaagtgaaaaaaaaaaaagggagaggcgagggagataaataaaaagacgatagaggagaggaaaaaacaatcgagagaggagcaaaagtgaaaagagagacgaaaaaaccccaacccgcgacgagggcggcaccaacagacgcgaagcgcccaagcacacgaacgaagacataaaaataaggacccacgggagggagagacacacaaacacaagaggaacaattatgcaactagagggcgaaacacaaccacaacggaataggcgagagcacgaaggaaaaacacgccgcagaggagaggaacacagacacaaaaaatacccaggagg

SEQ ID NO: 454147 - DNA, 3492 bp, Homo sapiens
tcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtccctgcccttagcggggcttgccccagtcgcaggggcacatccagccgctgcggctgacagcagccgcgcgcgcgggagtctgcggggtcgcggcagccgcacctgcgcgggcgaccagcgcaaggtccccgcccggctgggcgggcagcaagggccggggagagggtgcgggtgcaggcgggggccccacagggccaccttcttgcccggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgtgtgtctgtctttgtgggagggtaagacaatatgaacaaactatgatcacagtgactttacaggaggttgtggatgctccagggcagcctccaccttgctcttctttctgagagttggctcaggcagacaagagctgctgtccttttaggaatatgttcaatgcaaagtaaaaaaatatgaattgtccccaatcccggtcatgcttttgccactttggcttctcctgtgaccccaccttgacggtggggcgtagacttgacaacatcccacagtggcacggagagaaggcccataccttctggttgcttcagacctgacaccgtccctcagtgatacgtacagccaaaaaggaccaactggcttctgtgcactagcctgtgattaacttgcttagtatggttctcagatcttgacagtatatttgaaactgtaaatatgtttgtgccttaaaaggagagaagaaagtgtagatagttaaaagactgcagctgctgaagttctgagccgggcaagtcgagagggctgttggacagctgcttgtgggcccggagtaatcaggcagccttcataggcggtcatgtgtgcatgtgagcacatgcgtatatgtgcgtctctctttctccctcacccccaggtgttgccatttctctgcttacccttcacctttggtgcagaggtttcttgaatatctgccccagtagtcagaagcaggttcttgatgtcatgtacttcctgtgtactctttatttctagcagagtgaggatgtgttttgcacgtcttgctatttgagcatgcacagctgcttgtcctgctctcttcaggaggccctggtgtcaggcaggtttgccagtgaagacttcttgggtagtttagatcccatgtcacctcagctgatattatggcaagtgatatcacctctcttcagcccctagtgctattctgtgttgaacacaattgatacttcaggtgcttttgatgtgaaaatcatgaaaagaggaacaggtggatgtatagcatttttattcatgccatctgttttcaaccaactatttttgaggaattatcatgggaaaagaccagggcttttcccaggaatatcccaaacttcggaaacaagttattctcttcactcccaataactaatgctaagaaatgctgaaaatcaaagtaaaaaattaaagcccataaggccagaaactccttttgctgtctttctctaaatatgattactttaaaataaaaaagtaacaaggtgtcttttccactcctatggaaaagggtcttcttggcagcttaacattgacttcttggtttggggagaaataaattttgtttcagaattttgtatattgtaggaatcctttgagaatgtgattccttttgatggggagaaagggcaaattattttaatattttgtattttcaactttataaagataaaatatcctcaggggtggagaagtgtcgttttcataacttgctgaatttcaggcattttgttctacatgaggactcatatatttaagccttttgtgtaataagaaagtataaagtcacttccagtgttggctgtgtgacagaatcttgtatttgggccaaggtgtttccatttctcaatcagtgcagtgatacatgtactccagagggacagggtggaccccctgagtcaactggagcaagaaggaaggaggcagactgatggcgattccctctcacccgggactctccccctttcaaggaaagtgaacctttaaagtaaaggcctcatctcctttattgcagttcaaatcctcaccatccacagcaagatgaattaagttattttctagtggactcctgctggcccggtggtgcaaaccgaagcgtgttccgaagcatgc

SEQ ID NO: 454148 - DNA, 718 bp, Homo sapiens
gtgactgctcagaacttgctgctgtcaggccccaggttcacagcagtaggggctgggcttccagcaggctcatgattcaggccttaacccttgccctgggagcccccaaggataataacatcccttgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaatatataacaaaaaacaaaaaacataaaaaaaaaaaaaaggggggggctttttttgggggggggggaacaaaaagaggtgtaaatagataggggaacatggggggaaaaggtggttttggggacaaccatttttttggcaaaaaggggggaaaaagggggggcccacaaaggggggggagaaaaaattagaaaggagggatacgttagtg

SEQ ID NO: 454149 - DNA, 3649 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454150 - DNA, 3712 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgtgcgcttctggaaggccggggtgggagctctccgggaagaggagggggcatgctggggtggttccctggcatgtgaggaccctcctctcccatcttggctgcaggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454151 - DNA, 4539 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcaggtaggacaccccaaggaggctgcatatgggggtgagaggctaggtctggagtcctgggcctcctggagaactgggcatggtagtcgaatccaggaggtggagtccggggaggcatcctgagcagtggagaggtacgcccttgttccctcctaggggcccaggacatgggaagtgagacctgggctgtgccccccacacctccaggtgacctgctctcagtctgcacaagcctctccaaatcttctttcccctcactccctcctccctcattgtgcctccaccacgctgcctccgtaatctctgcccggatagccaccattttgccccaggatgggaatctcaagcctggagagggaacttaagggtggcagagccgtggagcactcacacatccatgcccctgctccctccaccccagttctgcccccagaattaagacaattaattaaacactgatcctgctccctaagtctgcaaggggagagctgggttgttccagtaggagaacctggtcttggtccatccttcaggaagggtcctggaaaggtgggggtctgacagtttaggagaaggctctctggggcggctctgctagaccaccaacccttaggctggcctccagccaggcagccttgctcacaccctgggctcaccttgccctgctcctgagaggacctttcctaaaccagtcaacgaagagaagacgctttagggcctctgtagaatgaaccttccttgacctgagaagagggggccctcagggccattgctttcccggtgtagtgtttcgctcagttcttttctcagcaagggagtgggaacgtgggctagccaggccttgagccccacgtttacctttctcctttcccgggtccctgttcccttcccagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454152 - DNA, 2793 bp, Homo sapiens
taattaaggtaaaaataacgcacttttttttttgcggaacctgaaaaattcaagaagttgaaaaacgcttttcacgtcacctggagagatgcacagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454153 - DNA, 3568 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454154 - DNA, 2246 bp, Homo sapiens
atcgcccacgcgtccgcggacgcgtggggacccagctcgggccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454155 - DNA, 3712 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaaggcgggcacatcaactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454156 - DNA, 3648 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagacctacctcacgtcacctcccagctccaccgagcgtcttagcgccctctgggatgtaagtatccataggggcccaccagtgggccataaggtcctgttgtgtctttcgttagggcctcaaaacaccccagcaccgaacaatgtc

SEQ ID NO: 454157 - DNA, 3606 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454158 - DNA, 3613 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454159 - DNA, 3525 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454160 - DNA, 3260 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454161 - DNA, 1804 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaagggcttgtgtgtgtcactgtatagagaataagttgtatgtggaaacaggaggagaaaggaagggacccaaggcatgagccaccattttggtttcccagggtggcccacgccccgacttacccactccggaggcctgctgggcagcgttggtagctggccagaccaagccagagaagcccagtaacccaaccagcactccagtgtcctgcctcc

SEQ ID NO: 454162 - DNA, 297 bp, Homo sapiens
cagtgaccaccgagagctgattggagattactctaaggtacctgcagcagcgaagggggtaccttgggggcttgacctcttactgactaggggtcctctagcccaggggctgcttgggttcctccctttctccccggagccccccttttctttgtcctttgtatcttttcatcctttgttctcacatagactcctccctctggccctccttgtctcctgactccacctcaagtcagtccaggcatctgttgagtctccgtcttatttccaagctcatacctagcttggaaccccctc

SEQ ID NO: 454163 - DNA, 3060 bp, Homo sapiens
ggcacgaggaagacaaaaaaaaaataagcgtaacttccctcaaagcaacaacccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454164 - DNA, 3607 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454165 - DNA, 3526 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454166 - DNA, 2797 bp, Homo sapiens
tgcgcggtcagaggcgcctggagcgagcgaatcctggcccaccgcctgcccaaccgcgtgaccttgattgagttaatgaacttcacgcctcagcgtccagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454167 - DNA, 3873 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaaaaaaaaaacagacgcgagatatagtcatatatccccgggagccaatcgtgcggagggaccccggagatatattccacgagctaagaatattacgatgcttcgggcaccatggttacccccttgccaggttatccatgaaactctgtcggggaagctactgacacgggccatgctacttgcccaaaaggtgtggccccggaatgtcgtgaagcgggggtcaaatt

SEQ ID NO: 454168 - DNA, 3728 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggttgttccctgggtgtcagacccaagaggtgcctctcagttgccatgggaaccagaactgaatttgaaggccaaagcaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454169 - DNA, 3618 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454170 - DNA, 2582 bp, Homo sapiens
tgatatcgtcgaccacgccgtcgcgaaacgagcagtttgccatcagacgcttccagtctatggcggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggttgttccctgggtgtcagacccaagaggtgcctctcagttgccatgggaaccagaactgaatttgaaggccaaagcaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454171 - DNA, 1695 bp, Homo sapiens
tcagtttacagcgtcagggtcagtttacagcgtcagggtcagtttacagcgtcagatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagcctgaacagaagctcttactctttcctatttcagtgttacctgtgtgcttggtctgtttgactttacgcccatctcaggacacttccgtagactgtttaggttcccctgtcaaatatcagttacccactcggtcccagttttgttgccccagaaagggatgttattatccttgggggctcccagggcaagggttaaggcctgaatcatgagcctgctggaagcccagcccctactgctgtgaaccctggggcctgactgctcagaacttgctgctgtcttgttgcggatggatggaaggttggatggatgggtggatggccgtggatggccgtggatgcgcagtgccttgcatacccaaaccaggtgggagcgttttgttgagcatgacagcctgcagcaggaatatatgtgtgcctatttgtgtggacaaaaatatttacacttagggtttggagctattcaagaggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454172 - DNA, 3113 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcaggtgctgtccatgggaaagatggtgtgggtgtcctgcctgtctgccccagcccagattcccctgtgtcatcccatcattttccatatcctggtgccccccacccctggaagagcccagtctgttgagttagttaagttgggttaataccagcttaaaggcagtattttgtgtcctccaggagcttcttgtttccttgttagggttaacccttcatcttcctgtgtcctgaaacgctcctttgtgtgtgtgtcagctgaggctgggggagagccgtggtccctgaggatgggtcagagctaaactccttcctggcctgagagtcagctctctgccctgtgtacttcccgggccagggctgcccctaatctctgtaggaaccgtggtatgtctgccatgttgcccctttctcttttcccctttcctgtcccaccatacgagcacctccagccaccaagagccacccaacgagccccacgaagagccacacgaagagccacgctacgagcctcaccatgagccac

SEQ ID NO: 454173 - DNA, 2736 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtgtctcagtcctgaccggaagatggaagtggaggagctcagccccctggccctaggtcgcttctctctgacccctgcagagggggatactgaggaagatgatggatttgtggacatcctagagagtgacttaaaggatgatgatgcagttcccccaggcatggagagtctcattagtgccccactggtcaagaccttggaaaaggaagaggaaaaggacctcgtcatgtacagcaagtgccagcggctcttccgctctccgtccatgccctgcagcgtgatccggcccatcctcaagaggctggagcggccccaggacagggacacgcccgtgcagaataagcggaggcggagcgtgacccctcctgaggagcagcaggaggctgaggaacctaaagcccgcgtcctccgctcaaaatcactgtgtcacgatgagatcgagaacctcctggacagtgaccaccgagagctgattggagattactctaaggccttcctcctacagacagtagacggaaagcaccaagacctcaagtacatctcaccagaaacgatggtggccctattgacgggcaagttcagcaacatcgtggataagtttgtgattgtagactgcagatacccctatgaatatgaaggcgggcacatcaagactgcggtgaacttgcccctggaacgcgacgccgagagcttcctactgaagagccccatcgcgccctgtagcctggacaagagagtcatcctcattttccactgtgaattctcatctgagcgtgggccccgcatgtgccgtttcatcagggaacgagaccgtgctgtcaacgactaccccagcctctactaccctgagatgtatatcctgaaaggcggctacaaggagttcttccctcagcacccgaacttctgtgaaccccaggactaccggcccatgaaccacgaggccttcaaggatgagctaaagaccttccgcctcaagactcgcagctgggctggggagcggagccggcgggagctctgtagccggctgcaggaccagtgaggggcctgcgccagtcctgctacctcccttgcctttcgaggcctgaagccagctgccctatgggcctgccgggctgagggcctgctggaggcctcagggaaatgtcacagaagcagctaaaccaaggactgagcaccctctggattctgaatctcaagatgggggcagggctgtgcttgaaggccctgctgagtcatctgttagggccttggttcaataaagcactgagcaagttgagaaa

SEQ ID NO: 454174 - DNA, 1511 bp, Homo sapiens
tgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcctgcggaggccaccctagggcgttgctgctgcctttgggagtgtggagctccaaaccatgtcgcgagaggcggattttgggaggccgggatcctcgcgccagggggatgtgcgagggtgtgggataaatcttaattcctccggcccacccaaagcctggaaatccagcctccgcgcctcttgccctgcgggccccgccctcagtcccgccctcatctaacccgctaccccattggtggcgtccggcggcgcggctgctgttatttttcgaatatataaggaggtggaagtggcagctgcaactagaggcttccctggctggtgcctgagcccggcgtccctcgccccccgccctccccgcatccctctcctccctcgcgcctggccctgtggctcttcctccctccctccttccccccccccccacccctcgcccgctgcctccctcggcccagccagctgtgccggcgtttgttggctgccctgcgcccggccctccagccagccttctgccggccccgccgcgatggaggtgccccagccggagcccgcgccaggctcggctctcagtccagcaggcgtgtgcggtggcgcccagcgtccgggccacctcccgggcctcctgctgggatctcatggcctcctggggtccccggtgcgggcggccgcttcctcgccggtcaccaccctcacccagaccatgcacgacctcgccgggctcggcagcgaaaccccaaagagtcaggtagggaccctgctcttccgcagccgcagccgcctgacgcacctatccctgtctcgacgggcatccgaatcctccctgtcgtctgaatcctccgaatcttctgatgcaggtctctgcatggattcccccagccctatggacccccacatggcggagcagacgtttgaacaggccatccaggcagccagccggatcattcgaaacgagcagtttgccatcagacgcttccagtctatgccggtgaggctgctgggccacagccccgtgcttcggaacatcaccaactcccaggcgcccgacggccggaggaagagcgaggcgggcagtggagctgccagcagctctggggaagacaaggagaatgatggatttgtcttcaagatgccatggaagcccacacatcccagctccacccatgctctggcagagtgggccagccgcagggaagcctttgcccagagacccagctcggcccccgacctgatgtttctcagtcctgaccggaagatggatgtggaggggatgatttagaggtcgctc

SEQ ID NO: 454175 - DNA, 4759 bp, Homo sapiens
  misc_feature (4559)..(4559): n is a, c, g, or t
  misc_feature (4561)..(4561): n is a, c, g, or t
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaaaaaaaaacnanagaaacacacaaacctttgtggggcagcctgggccctgaaaaaaagttctgtagaaccttcggtgtgggacgcggggcccatgatggttgtttaccgtgtgcgcaaagggtcccaagaaaaaacccgcgaaaagacacaagcggtggatttctcccgattaaaaaagcccggggcgaaacgaagtcttttaacaattg

SEQ ID NO: 454176 - DNA, 4340 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454177 - DNA, 4404 bp, Homo sapiens
cattttattgcattgattgtgcgttctcgattttacagagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454178 - DNA, 4951 bp, Homo sapiens
gtataacagctatccctttttgttacttttctacctgtgagtcttacgtcatcagcactcatttgttgaagattatggtattggctttacttcttttcctccatgatcccatcaacattcttgacatcctcaacatccacacatatgatccattaacctcacacccctgtctcccacccccatactctgtttctttgtgtcccattagacagatgggccatgctgtctaaatcttctgtgaaatcccagcatccacccttttctgatttctagcagcaggatgctttaggataataatggggatgtcagacagcagctgtattgtgttccagttgatcttggaagagcttcacttttgggtcttgcacatgtcccaggcttctttttttaaagagtctatcacctctttttctcctttctactttgtcatgtcctaagaacccaggtcttaggaaataaagttaattgctttgggacaaaatgcactttagctaatacttttgcttaaaattttatgtttaatggctcactaggcataattttgctctcttgatgctctagtaatgaactgtttcactattttacagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454179 - DNA, 4296 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaacgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454180 - DNA, 4729 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaaaaaaaagtttaatcgtcaagctgactctaccaggggccaatgtcacgtggcattttcggcctgttaaccacatgagtgtcatttccattacttgccttaactgaagaacgttactactgcaaggtggagcaattgcggctaggatcgaccctttcgcaattcctaggagtttgagctcc

SEQ ID NO: 454181 - DNA, 4491 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaacacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454182 - DNA, 4496 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454183 - DNA, 3686 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgtccgtccaagttgacggacgcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctgcccttctgcttctgagtgcacattaatcagattagcctgtattctcttcagtgaattttaataatggcttccagactctttggcgttgagacgcctgttagaatcttcaagtcccatcatagaaaattgaacacagagtgttctgctgatattttgggatacgtccgggatccta

SEQ ID NO: 454184 - DNA, 4550 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454185 - DNA, 4496 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454186 - DNA, 4817 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagcaatgaggtcttactgtgtagcccaggctgctctggaactcctggactcaagtgatcttcctaccttggtcttccaaagtgttgggattacaggaagtttatctcgacaatgctagttgcagtctgtgtgaccctgaccaagttattttaatgtctgtgctgcagtttttcagtttccaagatggaatagttatagtgcatatcttcctcatggttgtgaggagtgcatgacacatagcgagtgctcagtgaacagtcatttttctgagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454187 - DNA, 4652 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagtttttcagtttccaagatggaatagttatagtgcatatcttcctcatggttgtgaggagtgcatgacacatagcgagtgctcagtgaacagtcatttttctgagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454188 - DNA, 4777 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacattttaaaattaggtaaatgacctcatctttcaagcttgaattcatttttaattttaattttattttatacaatgtgtagacagttccctgttctctgcatttagaagtatacacaatataaatctgttaattctgtaagtaatttttataattatgatgtaactctatcttatccttaaaacatttaaaataaaccctttatgtgcaactcctgactgtaaaagtttgtgctgatgagcaacatgtgatgtgttaaacttgattctgaaaagttttttgggccaagtaaccttttcaccacatgtaaatgtcagatatgcatagaaagaaatagaatttttatttgataacattcaataatacctgaaagaagaggaggcagtcatcaatatcacacatatattaaatattgaagtttgcaatttgacattgaga

SEQ ID NO: 454189 - DNA, 4496 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcaaatgtagtgccaacagaaggtgattttccagttgtaaatgtcatgcagcatttgaagggactgtgttttcttaaaaaaaaatcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataacaaaataattatggttgaaatgtctgtggttccttggaaatgctgcgctctttgtgtttttccatcattagtgcagttggaatgaatgtgtataggtcagaggtcttcgtgttcacatttttttattttatacaatgtgtagacagttccctgttctctgcatttagaagtatacacaatataaatctgttaattctgtaagtaatttttataattatgatgtaactctatcttatccttaaaacatttaaaataaaccctttatgtgcaa

SEQ ID NO: 454190 - DNA, 3993 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagagtgcttgtgatttcacgtatttttgctgaactcgtaaaagagacacttggatggtggattaaccagaacactaacattctgtgaaaagtttcaaattggagaatattgaattttcaccctagtccagcagctccgctgctcacttaaatacagatgaatgaagaccccattcggaaagacacctggccagcggtccagagctgatgcaggccatgctggagtatctgccaacatgatgaagaagaggacatcccacaaaaaacatcggagcagtgtgggtccgagcaaacctgtttcccagccccggcggaacatcgtaggctgcaggattcagcatgggtggaaagaggggaatggccctgttacccagtggaaaggaaccgttctggaccaggtgcctgtaaatccttctttgtatcttataaaatacgatggatttgactgtgtttatggactagaacttaataaagatgaaagagtttctgcgcttgaagtcctccctgatagagttgcgacatctcgaatcagcgatgcacacttggcagacacaatgattggcaaagcagtggaacatatgtttgagacagaggatggttctaaagatgagtggaggggaatggtcttagcacgtgcacctgtcatgaacacatggttttacattacctatgagaaagaccctgtcttgtacatgtaccaactcttagatgattacaaagaaggcgaccttcgcattatgcctgattccaatgattcacctccagcagaaagggaaccaggagaagttgtggacagcctggtaggcaaacaagtggaatatgccaaagaagatggctcgaaaaggactggcatggtcattcatcaagtagaagccaagccctccgtctatttcatcaagtttgatgatgatttccatatttatgtctacgatttggtgaaaacatcctagatgtcatcacaaactctgccaaatttgtggaactatgaaatgtattatttgtagacataaagacttgattgctttccagtttaatgaaagcttaaatgtccctgcgaacccacaatctctgccagcagaactggttttgttctgaatagtacagattgatgtgaacacaaagcattttgtgtaaggagaacccctttcttttaaaagaagtctgtctatttcgaggggagttacaggcaagtttggtaaaagttaagctagtatcatagtcatttaaaattgtaatagatcttaaccattttccccctcaccctaactctcttattctgccgccacaatgcaagcatagtttgatgttttcgttattgccttttttgagatgtatgtatctgtatctacctatatctatatgtgtgtatacatatataatatatacacacagatacaagtgtacacacacacaccacacaccacacacaccccactggcagtctttgtggattaggatgggggtgacataattttcttgagtttaacaggagtgctttacccaagtcagtcatggatatgatatcactgctctttatttaaaagtaaactttgggcacaggaaccatatgggaacattcagcttgtttaaaaaaaaaaaatcagaagttcagagcaccttttcaatctggagcccttaaaccataagtccaaatatgaattatttgtgaacagttaatgacccatattagaattttacaatctggtgaacaatctgggtaaaaggctacctttaattctaagcttcatttttttttgggggggggttacattttaatcataaattcttttttgcaaagcccaggttcttgttccacacagtgtaatgtaggtgtattttggacagcacatatggtccattgtgtacaagtcagtaatctggatttcagtacatggatttaaaaggcaacaatccatcactggtttgtgtgtttttggttaagtttctggaagaatacaatgcttttatattggaagtataagttttgagtggcattgttgccttctaacaagctctctgggacttttaaagttttattactattattgctaatgtatgattatggtcagagactttcaacccaccccttcctgcctacccctggcttttcctcacaaagaatgtctagacaaacagcagcttagtctcctgacacctcttgtggggtgcatgttcctgctccaggtatgctgttcatgtggattcattccattcagtggccccttggggtttgcatgccagtgaagcgttaccatagaagagccagccgtttgtgttcgcttggtaggtgtaagtaatagcagcccttagccacggagtctttatgtggtttattcctgcaaggttgttttaaactgaaatagaactgctagtgtgattggttgatcagcaaaacagctgctctcattttgttttggaggaaccctggtggtttgacagccaggagaaaggccatatgtgaaaccagtctcttgtggagattggaaatcctccctgatatttgggcagagcctaaacgtgcatgcttgtcactcaaacaccagaagtttgaatcagaggtctgagtgacctcttttgtggctgttcttgatggtttccaggcctcgttatgcatggtttgcttgatgcccattttttgtgccttgtgctgttggatggtaacgaccactcaccatgtaaacacagtacctcagttttctgtccacagctgcagtcgctctgtccctcgtgcttcactgtgggcagccagggacaagcttctgaaagcagtgtgatacccaagtcataggtgcttctcgtatgtgaacaggtgtcattctacagatctgttatgtgttttcctgttgactcttaagagtccctgcatgtaaatctcaaagctgagcctggctcccagagtccagactgacattacagcgcaagagtttgcaagtgtgtccagcatgcaccaactgtgcagaacttggctcggtaactttgcgtggaaaaataaagtacattttgaagtatcttgagggttgggtcaattgagacatttctagcattacttaatgacttgcattgtggtttttctgcaagcaactttaatgactttttttataccacatggtctcccagtttctagatgaatgcaacatgatgatggtgatgatgacgatgagtttaatcattgttcatttattgcctttagggctgagggaaagggaaggtttgtttttttttctccccattttcccccattctgtctttcttttggtgacttacaccacatgtaatgacgctatgactaattctgctcccaagcccttgtatcttgggcttcattttaggctcatgtgtcagatctgcatgcattgcttgcatttttctggtatctgaatgttggttccttgttccaggaattcaacattaatttccaaaagtatcatgggacttgtgacaatacaagacatgaatctatgtataaaatttatcggcctttctcatttacctgctctagtattattgtattgtgtgtgcgtgcgtgtgtgatgtcaggctgccacgtaaaacttcagagaaaaatcttaaaagcagaccatccttttttgcatgctctattctaagtagaatgttcaatgtaactgactaaaattgcatgttaaagatatttaggtttttttgttttctttatttttatttgttttcagtttcctgtatatttgcttactgtgccgttttagtggttttaggataaaaatgcactggtgaagcacagacacctatccgaatgtcactgcccattttcatcatcacgaggttaacgcgtat

SEQ ID NO: 454191 - DNA, 686 bp, Homo sapiens
ggcgcggccgtcgcagttcggcgggcgcagtgcgcgtgcgccctgactgttggggggcgggcggcgtccgcggcgagggagcgggggcggggaggcgccgtctggctcaggctggggccggcgggagcgcgaacgagcgacggcggaacccgtgggcctgtggactgcagcctcggcggtcagcagcaatgaggtcttactgtgtagcccaggctgctctggaactcctggactcaagtgatcttcctaccttggtcttccaaagtgttgggattacaggaagtttatctcgacaatgctagttgcagtctgtgtgaccctgaccaagttattttaatgtctgtgctgcagtttttcagtttccaagatggaatagttatagtgcatatcttcctcatggttgtgaggagtgcatgacacatagcgagtgctcagtgaacagtcatttttctggtaagtagttggagaattttttgatctcctttgagattgcaatagaatgagaattttgagtttcagaatttaagttcatgacacatttttaagattagtaaaattgcaagcctggatactgttagataagagttctaaatttctcttcaaagaatcaatatgtcagtatgttcaattctttgccttctacttttccaccctggctcattctgattacctgctccaccctgact

SEQ ID NO: 454192 - DNA, 783 bp, Homo sapiens
ttctcccttatggtctttggacagatgcagtactgtaaagggccgatactgttttttcccctttaatcttgactgttatagaacagtcttcactgtatatagaacctttaattttatctcttgaaaatgaggatcttggccaggcgcagtggctcacacttgtaatcccagcactttgggaggccaaggcgggcggatcacttgaggtcaggaggccagcctggccaacatggtgaaacccagtctctactaaaaatacaaagattagccaggcatggtggcacgtgcctgtagtcccagctactcgggaggctgagacaggagaatcacttgaacctgggaggtagaggttgcagtgagctgagattgtgccactgcactccaacctgggcaacagggcgagactctgtcttaaaaaaaggaaaaagaaaaagaaaaagaaaatgagggtcttatcatttccctaatgttttctcccatcacttaaacctcacactaaatggtttcattcacataatcacatgtattctatatacttgtaaaatgtatttggtttggcttagctatttaccacatttaagaaatgattgtttctcttagaatgtttatctttttctcccccaacagaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454193 - DNA, 332 bp, Homo sapiens
cagggcgagacctgtcaaaaaactcccatcacttaaacctcacactaaatggtttcattcacataatcacatgtattctatatacttgtaaaatgtatttggtttggcttagctatttaccacatttaagaaatgattgtttctcttagaatgtttatctttttctcccccaacagaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454194 - DNA, 666 bp, Homo sapiens
tcagcatccacctcagcctcccaaagtgccaggatgaccgaagtgagccactgtgcctggccacatgaattctgttttatttaatgtgtggtagaaccaaaattgagccaagcagtctgactctggagtttgtacccttaattacctccttaaactacctctgagaatattgtgctcctggctccagccttgctttctcgcactgcagctcataaggacgtgggtttgggcctctactgttgaggatcttaaggaggccaggaagcagcaccatttttctttgacgtatttcctgctggcttcttccatagtctgaattgaataacagtaagatttactattttaaagccaaataatggtgtactaagtgtgaatgggggggggggttcagtctttgcattttaattttatggtttgttagaaatagactttgcttttcttctttcaaacccaccatcttagactgtgtagagatgaagtttgcaataaataataccttatgattatatgtgtttcttttttaatatccagggtaccacagatataagaggagtggggacagaattaagcacaaggtaactataaattgcattccagttacaggaacacacagtgattcagtggtgtgacagagacaaggatgtaactatttcatgactattggat

SEQ ID NO: 454195 - DNA, 1211 bp, Homo sapiens
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454196 - DNA, 1359 bp, Homo sapiens
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454197 - DNA, 1639 bp, Homo sapiens
  misc_feature (1239)..(1239): n is a, c, g, or t
  misc_feature (1250)..(1250): n is a, c, g, or t
  misc_feature (1257)..(1257): n is a, c, g, or t
  misc_feature (1266)..(1266): n is a, c, g, or t
  misc_feature (1269)..(1269): n is a, c, g, or t
  misc_feature (1274)..(1274): n is a, c, g, or t
  misc_feature (1289)..(1289): n is a, c, g, or t
  misc_feature (1292)..(1292): n is a, c, g, or t
  misc_feature (1303)..(1303): n is a, c, g, or t
  misc_feature (1306)..(1307): n is a, c, g, or t
  misc_feature (1319)..(1319): n is a, c, g, or t
  misc_feature (1323)..(1323): n is a, c, g, or t
  misc_feature (1326)..(1327): n is a, c, g, or t
  misc_feature (1329)..(1331): n is a, c, g, or t
  misc_feature (1337)..(1337): n is a, c, g, or t
  misc_feature (1348)..(1348): n is a, c, g, or t
  misc_feature (1351)..(1351): n is a, c, g, or t
  misc_feature (1353)..(1354): n is a, c, g, or t
  misc_feature (1372)..(1373): n is a, c, g, or t
  misc_feature (1381)..(1381): n is a, c, g, or t
  misc_feature (1386)..(1386): n is a, c, g, or t
  misc_feature (1397)..(1397): n is a, c, g, or t
  misc_feature (1399)..(1399): n is a, c, g, or t
  misc_feature (1402)..(1402): n is a, c, g, or t
  misc_feature (1406)..(1407): n is a, c, g, or t
  misc_feature (1410)..(1410): n is a, c, g, or t
  misc_feature (1416)..(1416): n is a, c, g, or t
  misc_feature (1418)..(1418): n is a, c, g, or t
  misc_feature (1424)..(1424): n is a, c, g, or t
  misc_feature (1426)..(1426): n is a, c, g, or t
  misc_feature (1429)..(1429): n is a, c, g, or t
  misc_feature (1433)..(1433): n is a, c, g, or t
  misc_feature (1444)..(1444): n is a, c, g, or t
  misc_feature (1446)..(1447): n is a, c, g, or t
  misc_feature (1451)..(1452): n is a, c, g, or t
  misc_feature (1460)..(1460): n is a, c, g, or t
  misc_feature (1473)..(1473): n is a, c, g, or t
  misc_feature (1475)..(1475): n is a, c, g, or t
  misc_feature (1490)..(1490): n is a, c, g, or t
  misc_feature (1494)..(1494): n is a, c, g, or t
  misc_feature (1500)..(1500): n is a, c, g, or t
  misc_feature (1510)..(1510): n is a, c, g, or t
  misc_feature (1513)..(1513): n is a, c, g, or t
  misc_feature (1517)..(1517): n is a, c, g, or t
  misc_feature (1523)..(1523): n is a, c, g, or t
  misc_feature (1537)..(1537): n is a, c, g, or t
  misc_feature (1562)..(1562): n is a, c, g, or t
  misc_feature (1564)..(1564): n is a, c, g, or t
  misc_feature (1566)..(1566): n is a, c, g, or t
  misc_feature (1575)..(1575): n is a, c, g, or t
  misc_feature (1579)..(1580): n is a, c, g, or t
  misc_feature (1592)..(1592): n is a, c, g, or t
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaaaaaaaaaaaaaaaaaaaaaaaanaaaaaaaaaanaattttntccagacanccncgggnctgtttccaaagggnggngcaaacccccnttnnttaaaattttantttngannannntaaacnaaaaagggttnaanannattatttcaaggctgagnnccaatttngatgntggccttttgnanagngggnnccnttcttngnccgcantncantttnaaaaatttaangnngccnnttcatttntgattaaagttcntnaaaaaaatccagggntttngggatntcccaaaccntanctgnaggccntttttttaatttantgccccctaattcccaattttaatncntnaaaaagggnaaanncccccaacttgncaaaaattaaccccccattttgtaaaagtcccaaccaccctccacct

SEQ ID NO: 454198 - DNA, 1198 bp, Homo sapiens
aagcagtggtatcaacgcacagtgcccattacggccgggtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454199 - DNA, 1549 bp, Homo sapiens
  misc_feature (1246)..(1246): n is a, c, g, or t
  misc_feature (1251)..(1251): n is a, c, g, or t
  misc_feature (1254)..(1254): n is a, c, g, or t
  misc_feature (1259)..(1261): n is a, c, g, or t
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaaaaaaaaaaaaaaaaaaaaaaaaaaaaaaanaaaanaanaaaannnaaaaaaaaaaaaaaaaaaaaaaaaggggggggggaggggcggagacggggacacacgcagggggggggggcgggggaaaagaagaacatgaagaacaggggccgacgaggggcaaaggagagaagggaagaagagaagaagaggcgagaagcggaagaaaaaaaaaaacgcgcgggggagcgagcaaggagaggaagaaaaagagcacgaggggagagaaagaggagaggggcgagaaaaaagaaaggcgcgaggggggacggcagagaggggagcgacaggggggct

SEQ ID NO: 454200 - DNA, 1658 bp, Homo sapiens
  misc_feature (1217)..(1217): n is a, c, g, or t
  misc_feature (1227)..(1227): n is a, c, g, or t
  misc_feature (1302)..(1302): n is a, c, g, or t
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaantttttttttntgtggaatgtaactcttttattaaaacagttgtctttccacagtagtaaagctttggcacatacagtataaaaantaatcacccaccataattatccaaattcctcttatcaactgcatactaagtgttttcaatacaattttttccgtataaaaatactgggaaaaattgataaataacaggtaagagaaagatatttctaggcaattactaggatcatttggaaaaagtgagtactgtggatatttaaaatatcacagtaacaagatcatgcttgttcctacagtattgcgggccagacacttaagtgaaagcagaagtgtttgggtgactttcctacttaaaattttggtcatatcatttcaaaacatttgcatcttggttggctgcatatgctttcctattgatcccaaaccaaatcttagaatcac

SEQ ID NO: 454201 - DNA, 1238 bp, Homo sapiens
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggggcttaatgaagagaaaataaagcggtgaaaagaggcctgttcggtggaagacggggaagggagggggggaaa

SEQ ID NO: 454202 - DNA, 1013 bp, Homo sapiens
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454203 - DNA, 1427 bp, Homo sapiens
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggcatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454204 - DNA, 1155 bp, Homo sapiens
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454205 - DNA, 963 bp, Homo sapiens
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggcatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggtatccccatagtgcgggagtttagccgcctattcatatgaccacccgactggtgtttggactcttctctt

SEQ ID NO: 454206 - DNA, 879 bp, Homo sapiens
ttctcccttatggtctttggacagatgcagtactgtaaagggccgatactgttttttcccctttaatcttgactgttatagaacagtcttcactgtatatagaacctttaattttatctcttgaaaatgaggatcttggccaggcgcagtggctcacacttgtaatcccagcactttgggaggccaaggcgggcggatcacttgaggtcaggaggccagcctggccaacatggtgaaacccagtctctactaaaaatacaaagattagccaggcatggtggcacgtgcctgtagtcccagctactcgggaggctgagacaggagaatcacttgaacctgggaggtagaggttgcagtgagctgagattgtgccactgcactccaacctgggcaacagggcgagactctgtcttaaaaaaaggaaaaagaaaaagaaaaagaaaatgagggtcttatcatttccctaatgttttctcccatcacttaaacctcacactaaatggtttcattcacataatcacatgtattctatatacttgtaaaatgtatttggtttggcttagctatttaccacatttaagaaatgattgtttctcttagaatgtttatctttttctcccccaacagaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaaaccccctgggcccaatttgaatttaaggtttatggaacccgccaccctgagggggggcccgcgccccaaaatccccctaaagggaggcggt

SEQ ID NO: 454207 - DNA, 612 bp, Homo sapiens
tcagcatccacctcagcctcccaaagtgccaggatgaccgaagtgagccactgtgcctggccacatgaattctgttttatttaatgtgtggtagaaccaaatacctctgagaatattgtgctcctggctccagccttgctttctcgcactgcagctcataaggacgtgggtttgggcctctactgttgaggatcttaaggaggccaggaagcagcaccatttttctttgacgtatttcctgctggcttcttccatagtctgaattgaataacagtaagatttactattttaaagccaaataatggtgtactaagtgtgaatgggggggggggttcagtctttgcattttaattttatggtttgttagaaatagactttgcttttcttctttcaaacccaccatcttagactgtgtagagatgaagtttgcaataaataataccttatgattatatgtgtttcttttttaatatccagggtaccacagatataagaggagtggggacagaattaagcacaaggtaactataaattgcattccagttacaggaacacacagtgattcagtggtgtgacagagacaaggatgtaactatttcatgactattggat

SEQ ID NO: 454208 - DNA, 420 bp, Homo sapiens
attttaattttatggtttgttagaaatagactttgcttttcttctttcaaacccaccatcttagactgtgtagagatgaagtttgcaataaataataccttatgattatatgtgaaaacccagagaacttagtgaagtctcattaatttactttcaaagtgtggttgtttcttttttaatatccagggtaccacagatataagaggagtggggacagaattaagcacaaggtaactataaattgcattccagttacaggaacacacagtgattcagtggtgtgacagagacaaggatgtaactatttcatgactattggatagcactatttattactaatatgtcttattgaataaatgttttagaagtaaaatgcccattcccatcaagaccagacaatggatttgtgaactatcctgc

SEQ ID NO: 454209 - DNA, 1481 bp, Homo sapiens
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454210 - DNA, 1470 bp, Homo sapiens
  misc_feature (1239)..(1239): n is a, c, g, or t
  misc_feature (1284)..(1284): n is a, c, g, or t
  misc_feature (1289)..(1289): n is a, c, g, or t
  misc_feature (1292)..(1292): n is a, c, g, or t
  misc_feature (1297)..(1299): n is a, c, g, or t
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaaaaaaaaaaaaaaaaaaaaaaaanaaaaaaaaaaaaaaaaaaaaaaaaaaaaaaaaaaaaaaaaaaaanaaaanaanaaaannnaaaaaaaaaaaaaaaaaaaaaaaaaaaaactttgggcccccttgggcccaatgatttttaaacctggacaatttttttcttggggcccaattttgggcccctttggccatttcccccttaaggggggcggttaaaaattcaagggccgggttttaaaaacgggggactggg

SEQ ID NO: 454211 - DNA, 1644 bp, Homo sapiens
  misc_feature (1255)..(1255): n is a, c, g, or t
  misc_feature (1262)..(1262): n is a, c, g, or t
  misc_feature (1271)..(1271): n is a, c, g, or t
  misc_feature (1274)..(1274): n is a, c, g, or t
  misc_feature (1279)..(1279): n is a, c, g, or t
  misc_feature (1294)..(1294): n is a, c, g, or t
  misc_feature (1297)..(1297): n is a, c, g, or t
  misc_feature (1308)..(1308): n is a, c, g, or t
  misc_feature (1311)..(1312): n is a, c, g, or t
  misc_feature (1324)..(1324): n is a, c, g, or t
  misc_feature (1328)..(1328): n is a, c, g, or t
  misc_feature (1331)..(1332): n is a, c, g, or t
  misc_feature (1334)..(1336): n is a, c, g, or t
  misc_feature (1342)..(1342): n is a, c, g, or t
  misc_feature (1353)..(1353): n is a, c, g, or t
  misc_feature (1356)..(1356): n is a, c, g, or t
  misc_feature (1358)..(1359): n is a, c, g, or t
  misc_feature (1377)..(1378): n is a, c, g, or t
  misc_feature (1386)..(1386): n is a, c, g, or t
  misc_feature (1391)..(1391): n is a, c, g, or t
  misc_feature (1402)..(1402): n is a, c, g, or t
  misc_feature (1404)..(1404): n is a, c, g, or t
  misc_feature (1407)..(1407): n is a, c, g, or t
  misc_feature (1411)..(1412): n is a, c, g, or t
  misc_feature (1415)..(1415): n is a, c, g, or t
  misc_feature (1421)..(1421): n is a, c, g, or t
  misc_feature (1423)..(1423): n is a, c, g, or t
  misc_feature (1429)..(1429): n is a, c, g, or t
  misc_feature (1431)..(1431): n is a, c, g, or t
  misc_feature (1434)..(1434): n is a, c, g, or t
  misc_feature (1438)..(1438): n is a, c, g, or t
  misc_feature (1449)..(1449): n is a, c, g, or t
  misc_feature (1451)..(1452): n is a, c, g, or t
  misc_feature (1456)..(1457): n is a, c, g, or t
  misc_feature (1465)..(1465): n is a, c, g, or t
  misc_feature (1478)..(1478): n is a, c, g, or t
  misc_feature (1480)..(1480): n is a, c, g, or t
  misc_feature (1495)..(1495): n is a, c, g, or t
  misc_feature (1499)..(1499): n is a, c, g, or t
  misc_feature (1505)..(1505): n is a, c, g, or t
  misc_feature (1515)..(1515): n is a, c, g, or t
  misc_feature (1518)..(1518): n is a, c, g, or t
  misc_feature (1522)..(1522): n is a, c, g, or t
  misc_feature (1528)..(1528): n is a, c, g, or t
  misc_feature (1542)..(1542): n is a, c, g, or t
  misc_feature (1567)..(1567): n is a, c, g, or t
  misc_feature (1569)..(1569): n is a, c, g, or t
  misc_feature (1571)..(1571): n is a, c, g, or t
  misc_feature (1580)..(1580): n is a, c, g, or t
  misc_feature (1584)..(1585): n is a, c, g, or t
  misc_feature (1597)..(1597): n is a, c, g, or t
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaccggttttttttttttttttttttttttcatgggaaaatagttnaattttntccagacanccncgggnctgtttccaaagggnggngcaaacccccnttnnttaaaattttantttngannannntaaacnaaaaagggttnaanannattatttcaaggctgagnnccaatttngatgntggccttttgnanagngggnnccnttcttngnccgcantncantttnaaaaatttaangnngccnnttcatttntgattaaagttcntnaaaaaaatccagggntttngggatntcccaaaccntanctgnaggccntttttttaatttantgccccctaattcccaattttaatncntnaaaaagggnaaanncccccaacttgncaaaaattaaccccccattttgtaaaagtcccaaccaccctccacct

SEQ ID NO: 454212 - DNA, 1230 bp, Homo sapiens
gagagagagagagagagagagagagagagagagagagagagagagagagagagagagagagagagagagagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454213 - DNA, 1157 bp, Homo sapiens
gcgctttcatatttggctctgtctttttagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatatggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454214 - DNA, 1306 bp, Homo sapiens
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454215 - DNA, 1106 bp, Homo sapiens
tagtagagacggggtttcaccgtgttagccagcctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454216 - DNA, 1351 bp, Homo sapiens
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaagtacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgca

SEQ ID NO: 454217 - DNA, 654 bp, Homo sapiens
  misc_feature (614)..(614): n is a, c, g, or t
  misc_feature (627)..(627): n is a, c, g, or t
gggccgctgccgccatgttgttgtggttgtgagaaggcggcggcggcggcggagtagcagccggacgagacgtcccagcggctcaggcgctgcccagcgccggccctggcagggagcctggtggggtggcggagggggagactgtgccgtggagggcctcgccatgtcctgctgcccgatggagtctcgctttgtcactcaggctggagtgaagtggcatgatcttggttcactgcaaccactgcctcccaggttcaagcaatcctcctgcctcagcctccggagtagctgggattacagcagacgaaaaccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttancttgtaacactgngttttattgtggcgctggccctttttc

SEQ ID NO: 454218 - DNA, 1604 bp, Homo sapiens
ggcacgaggaaccatggagccagtgtctgggggcgtggtggcgggactggacctctggggcctgtgttgggccttagctcggtaactggtgacccctttgccctctgagcctgcttttcatcctgttgtgaatatcagatgagatcatacacatggaaatgcttgtcaactaaaacagcacaaacacagtgtaatgaattattattatcccagtaaagtcatggttcgggaaaatgagggaatgtgggctctgttgcgcgtgcctgggaagctaaacccctgcggtgttgttcctgtgggcaagtgtctagcgcatgcaggtgccgtctgacaagtcgacttcgctctgtgaaggtcgtgctcggccctgatgggatatacagccagggtggggcggcgcagtgaagatggctcttctctttctcccccgtgtccatccatcagaccacagcctttgcctgggcaggggtccccgtgtaggggtgaatgcctctcatgtggctgcctgcagcagggtggccctttgtgtacttgtctgagccagtgccacctacactcaagttgggacagtggagatactcggagaattgcccattcggtgacgatcccccaacagtaggtctccccctgatcactttacctgaccgcacacttcctttcttggacttaggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgaggtaagacacgaaggtggtaataaattggtctcaaattcctaggcttgctgtcccagacagtgacatacctttttcttgccttgctccaggttttagtgaagtaaatagtatttggaaagtttgtttgttttttttttcattgcaaagagaaaatgcaatagacatgagcatagaggaaaattaaaggtattacaaggaaatactgcgtgtaattctctgataatcaatttgaaaacctaatggttttctaaaatttgcaagttattggccaggtgtggtggctcacgcctgtaatcccagcactttgggaggccgaggcaggcagactgcctgagctcaggagtttgagatcaacctgggtaacatggcaaaaccccatctctacaaaaaatacaaaaataagctaggtgtggtggcgtgcactgtagtcccagctatttagggggctgaggtgggaggatcacttgagctcaggaggttgaggctgcagtgagctgagattgccccgttgcactccagcctgggggacagagtgagaccccgtctgtaaaaattaaaataaataaaataaataaaataaaatttatctaaattgacccagaacacatgaagtaagccatagctggagctcagaaatgatta

SEQ ID NO: 454219 - DNA, 636 bp, Homo sapiens
tcacttgaggccaggagttcgagaccagcctggtcaacatagcgagacttcgtcactagaaaaaatttaaaaaattttttaaaaaggaaaaaatataacttagagccccctatgaaaaactaaattagcatcatgacaggatacactttggggagtgaaatttcacagtacctttatttaattccaagccatagagcctggtaatatttttctctttatcagctgtggcactaaaataacagtggattttttccctctagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaa

SEQ ID NO: 454220 - DNA, 891 bp, Homo sapiens
ctcagtgggcagtggcaggaactgagcttgtcgggcccctgctgagagcaaagctgaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccgggcactgtggctcacgcgtgtaatcccagcactttgggaggccgaggcgggcggatcacaaggtcaggagatcaagaccatcctggccaacatggtgaaatgccgtctctactaaaaatacaaaaattagctgggtgtggtggcatgtgcctgtaatcccagctactccggaggctgaggcaggagaatcgcttaaacccgggaggcggaggttgcagtgagctaagatcacgccactgcactccagcctagtgaccaagtgagactgtctcaaaaaaataaataaataaaataaaa

SEQ ID NO: 454221 - DNA, 423 bp, Homo sapiens
cacggcccaccccatacagagcctccttccaccaaggccccgcctgattccttggctttccaaaccgccagcccacctggaacatgagcaaagctcacattctcccaagatggttgccagaaagatgctggactctgctcttaaccttggttttgtacccaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacaggtgagaagtggcaggtggttcatgttgactcagccctgggtgtcctcagtt

SEQ ID NO: 454222 - DNA, 4563 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454223 - DNA, 4388 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgccgggcactgtggctcacgcgtgtaatcccagcactttgggaggccgaggcgggcggatcacaaggtcaggagatcaagaccatcctggccaacatggtgaaatgccgtctctactaaaaatacaaaaattagctgggtgtggtggcatgtgcctgtaatcccagctactccggaggctgaggcaggagaatcgcttaaacccgggaggcggaggttgcagtgagctaagatcacgccactgcactccagcctagtgaccaagtgagactgtctcaaaaaaataaataaataaaataaaa

SEQ ID NO: 454224 - DNA, 4505 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454225 - DNA, 4630 bp, Homo sapiens
tcacttgaggccaggagttcgagaccagcctggtcaacatagcgagacttcgtcactagaaaaaatttaaaaaattttttaaaaaggaaaaaatataacttagagccccctatgaaaaactaaattagcatcatgacaggatacactttggggagtgaaatttcacagtacctttatttaattccaagccatagagcctggtaatatttttctctttatcagctgtggcactaaaataacagtggattttttccctctagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454226 - DNA, 4432 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtacttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454227 - DNA, 4203 bp, Homo sapiens
aacgcatataggctaggtacgaggcctggtgttgaatcggccgagggagagagaggcgtcaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454228 - DNA, 3422 bp, Homo sapiens
acgattcttctcataccatcttccccatcattttggggtctgtttcgactgactaattttgtttccgggttttggcctcattttcctgcctctacatttttcacaagtttttcttggttgttggatattgtcaggtgtacacttttgaatgtctggattttgttgtctttctctgaggagttgggttgggcttggcaggcagttaaggtgcagatcatccttccgaggctttttatgctttgaagtggtgggtctagcatagcctttccgcctcccgccaccggcgtccttcccaaggcctctgctgcacacccgtgtgtcccgcaaggcccgcgagacccctgcactcctgctgctgcaagatgacaccttctcggccctgtgagctccgctcgttgctccctggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454229 - DNA, 3167 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccacacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454230 - DNA, 2480 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgaggtaagacacgaaggtggtaataaattggtctcaaattcctaggcttgctgtcccagacagtgacatacctttttcttgccttgctccaggttttagtgaagtaaatagtatttggaaagtttgtttgttttttttttcattgcaaagagaaaatgcaatagacatgagcatagaggaaaattaaaggtattacaaggaaatactgcgtgtaattctctgataatcaatttgaaaacctaatggttttctaaaatttgcaagttattggccaggtgtggtggctcacgcctgtaatcccagcactttgggaggccgaggcaggcagactgcctgagctcaggagtttgagatcaacctgggtaacatggcaaaaccccatctctacaaaaaatacaaaaataagctaggtgtggtggcgtgcactgtagtcccagctatttagggggctgaggtgggaggatcacttgagctcaggaggttgaggctgcagtgagctgagattgccccgttgcactccagcctgggggacagagtgagaccccgtctgtaaaaattaaaataaataaaataaataaaataaaatttatctaaattgacccagaacacatgaagtaagccatagctggagctcagaaatgatta

SEQ ID NO: 454231 - DNA, 2919 bp, Homo sapiens
gagctgagaggaactggagagatcactgagccccttccatacacaggaaactgggggtctggagggtgaaggccctagagccgggacgcactccacccaggacactgttcctccagagtgacttgcttcccacatcagccaagtgaacgagcattttagagacatttcctcataagtttttttccttcccacagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454232 - DNA, 2335 bp, Homo sapiens
cctccactctgctctcttccagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454233 - DNA, 1470 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcagaatcttctcaattgaataagactagaagtatcagacggcgagattcctgtctaaattccaagacaaaggttatgcctactcctacaaatcaatttaaaattcctaagttttctattgctccccgaaagctttggtgttgagctgtccggggagt

SEQ ID NO: 454234 - DNA, 569 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaa

SEQ ID NO: 454235 - DNA, 3013 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcat

SEQ ID NO: 454236 - DNA, 4436 bp, Homo sapiens
  misc_feature (4135)..(4135): n is a, c, g, or t
  misc_feature (4152)..(4152): n is a, c, g, or t
  misc_feature (4218)..(4218): n is a, c, g, or t
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcanagacctgagctcccctntgatccagctgagccctgaggctgacaaggagaacgtggattccccactcctcaagttttaagccnaaccaaatcctttgccttgaaagaacagccctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454237 - DNA, 4237 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccgggcactgtggctcacgcgtgtaatcccagcactttgggaggccgaggcgggcggatcacaaggtcaggagatcaagaccatcctggccaacatggtgaaatgccgtctctactaaaaatacaaaaattagctgggtgtggtggcatgtgcctgtaatcccagctactccggaggctgaggcaggagaatcgcttaaacccgggaggcggaggttgcagtgagctaagatcacgccactgcactccagcctagtgaccaagtgagactgtctcaaaaaaataaataaataaaataaaa

SEQ ID NO: 454238 - DNA, 4150 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454239 - DNA, 4361 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454240 - DNA, 3687 bp, Homo sapiens
ggcacgaggaaccatggagccagtgtctgggggcgtggtggcgggactggacctctggggcctgtgttgggccttagctcggtaactggtgacccctttgccctctgagcctgcttttcatcctgttgtgaatatcagatgagatcatacacatggaaatgcttgtcaactaaaacagcacaaacacagtgtaatgaattattattatcccagtaaagtcatggttcgggaaaatgagggaatgtgggctctgttgcgcgtgcctgggaagctaaacccctgcggtgttgttcctgtgggcaagtgtctagcgcatgcaggtgccgtctgacaagtcgacttcgctctgtgaaggtcgtgctcggccctgatgggatatacagccagggtggggcggcgcagtgaagatggctcttctctttctcccccgtgtccatccatcagaccacagcctttgcctgggcaggggtccccgtgtaggggtgaatgcctctcatgtggctgcctgcagcagggtggccctttgtgtacttgtctgagccagtgccacctacactcaagttgggacagtggagatactcggagaattgcccattcggtgacgatcccccaacagtaggtctccccctgatcactttacctgaccgcacacttcctttcttggacttaggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccacgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaacctgtctca

SEQ ID NO: 454241 - DNA, 2272 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggtgggcagaacgggcgcagctgggttctgttagctgagattcctggaggctgctcgggaagcccgtggaacccagggctgtggctggcggagttccctgccatgcttcatcctggggccagtgcctccgtgccaagcaacccaaagggaggcagtcaggacttccaggcctccaggggagaaagccctgcatttgactaaggcaagggtcagggatcaaagctgaggaagcg

SEQ ID NO: 454242 - DNA, 1617 bp, Homo sapiens
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccacacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcat

SEQ ID NO: 454243 - DNA, 1091 bp, Homo sapiens
  misc_feature (954)..(954): n is a, c, g, or t
cccttttcaaaccgaccaatcggcaacccgcgtctcccggcgccgcgtttaaatccgtgccggaggcgcgtcctgcatcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaaaaaaaaaaaaaaaaaaaaaaacgggggcggcgcgcgcgccgcgggccccgcggaaaaaagtctttcctaaaaccaatgcgcgggggggcgcgcgggggccaccgagggaggaaagagggaacaaggggcgccaaaagcgggttccctagaggagagaacgcgcggggccgaggacacagagagagggcgggggaaatttctcccacacaaaataaaaagaggccgcgggggggacaaccgcgagagggttctgggaaaaaaaatcccgagagggggagttctcgggaggggcctataagaggggagcacctatacacaaagaggagaagtccccaaagcggagagccgccggaagatatccaaaaatataaagcgccccggagncggggggggggccccacgcaccaaaagcaagccgcacgaggcacgccaagaacaagcagaccgaggcgacgggacaaacaacgacgcccgcaacgacggccgccccaaagacaccacaacgacgtcaccacatcgcg

SEQ ID NO: 454244 - DNA, 1813 bp, Homo sapiens
cacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaa

SEQ ID NO: 454245 - DNA, 2638 bp, Homo sapiens
cacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcatgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaagttctctctctctctctctctctctctctctctctctgtgcgtgtgtgtgtgtgtttgggagaaatagaaacacttcaatttaagtagagctgctaaatttaattaaacttctgcttaagaaatgagttattttgagataaaagagggtagggtaaggaagcatctaagacgagaaagaaatgataaagtatgaaaagatttctagttgggacttgccttctattaactctttgaactgagaaacatccagtggcctgtgcatgacagtcactcatatgaaaggcagggtgtcacacctttcacagaaatgatagcaatactgtctaccatttactgagtacctagttggctaaagacactttacgtatgatcctcacaattactatatagtaggtgtaggcatacagataacaagtcaggaat

SEQ ID NO: 454246 - DNA, 1821 bp, Homo sapiens
gccaggcgcagtggctcacacctgtaatcccagcactttgggaggccgaggcgggtggattacaaggtcaggagatcgagaccatcctggctaacaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaa

SEQ ID NO: 454247 - DNA, 735 bp, Homo sapiens
cacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtaaatgcaatttcctgttcagaaaccacactaacattacttcttt

SEQ ID NO: 454248 - DNA, 714 bp, Homo sapiens
cacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaaggaatgagctatctttcagattaaggagactcccttctatacgaagtttgctggtagtgtttatagtgcttgtccattaaactttatcaaata

SEQ ID NO: 454249 - DNA, 1521 bp, Homo sapiens
cacagttgtacttttagcttcccccatcctgcaaggccactcaaccatgtgctagctggagtgatctttattcacaatgtctttacaaaggctcctgcaacacagcagcaatggcaatttggcggacttctgcgctgggccagcgtatagctcttactccacactcaccggcagccttacgatggacgataatagaaggattcaaatgctagcagacacggtggctactctgcctcggggacgaaagcagcttgctttgaccagatcaagttctttaagtgacttttcctggtctcaaagaaagcttgttactgtggagaagcaggataatgaaacatttggatttgaaattcagtcttacaggccccagaatcagaatgcctgctcctcggaaatgttcactttgatatgcaaaatacaggaggacagcccagctcactgtgctggcctgcaagctggtgatgtccttgcaaatatcaatggtgtgagcacagaaggttttacctacaaacaagtcgttgacctgatcagatcgtccggaaacctgctaacgatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatata

SEQ ID NO: 454250 - DNA, 2352 bp, Homo sapiens
ataagctatagtttacaaattaactaggatcctttcttttagccaccttctcaaggggagttttcccccattttctttctctgttatcagaagatttggctttggtccagctactcgaagtgccatgagaactgtaacatttgtatttcgtttttagtatagtatgtgctcaaagtgtagtactctgtagtatggtacttatttaaacgaatcactcatgttactcactccccaccttcctcttcttttttttttccttaaaacaggatagagactcttaatggaacaatgattctgaaaagaacggagcttgaagcaaagctgcaggttttaaagcaaactttgaaacaaaaatgggtggagtacagatctctgcagttacaggaacatcgtctgcttcatggtgatgcagctaattgccccagtttggaaaacatggacttggatgaattgtctttgtttggacccctgcctgggccaggcccagcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcatgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaagttctctctctctctctctctctctctctctctctctgtgcgtgtgtgtgtgtgtttgggagaaatagaaacacttcaatttaagtagagctgctaaatttaattaaacttctgcttaagaaatgagttattttgagataaaagagggtagggtaaggaagcatctaagacgagaaagaaatgataaagtatgaaaagatttctagttgggacttgccttctattaactctttgaactgagaaacatccagtggcctgtgcatgacagtcactcatatgaaaggcagggtgtcacacctttcacagaaatgatagcaatactgtctaccatttactgagtacctagttggctaaagacactttacgtatgatcctcacaattactatatagtaggtgtaggcatacagataacaagtcaggaat

SEQ ID NO: 454251 - DNA, 2119 bp, Homo sapiens
agtttactagtatcattggaacggtgctcgtgcccaagaaggtaggtggaacgtggtcctggcgtgtttccatagcgagattctgagtcatgacataggtgcgtgggtacactactctcattgtagaaaccgccacggtggtctgcgtacagggctgggtagcaaatccaatgagtgccgttctgggagaacatatagggtagctattgcaatcgtcagtgcaaggaccctctgatatgggaattgaggccacgcccttgtggaccggaatcgattatccagtgagagcagctgtaagagctggctgagctccatgacgatggacagtgaagatggctaccagacgtgtgtgtctgaggactccagcaggggtgccttcagtcggcagacgagtacagatgatgagtgctttatccccaaggagggggatgattttctgaggaggtcatcttcaaggaggaaccggagcatcagtaacaccagcagcggatccatgtctcccttgtgggagggcaacttatcaagcatgtttgggaccctgccccggaagagcagaaagggaagtgtccgaaagcaactcttgaaatttatccctggccttcatcgtgctgtggaagaggaagaaagtcgcttttgacggattgtggtgtcctttcaaattagcttatttcacaaatatctctagactcacccagatcccagcttggtgggaaagtgcagaagaattgcaaaactgacatcccatttcacagcaatagtgacctttatttaaattgttgtgttatagtttatgcttcttaaatcatttttcaacctaaacagccaatttctaagcagacaggaaaactaaataataagttaattaatataacaaagatgcaggttcctgctcattccagtaatgtctttgaaagcaaaactaatatttattttctagattatccctgtgaataattgagaactttttggagtcaagtatgaataaaggtgtggcagaatataataatctggactattttctataggataattgctgggttataaaatcttaggtttgcttatgcccagtagctcctgcggaggcttaataataggcaattttgaatttgttcaaacctgtaatggcttgtaaacaaagatgaccatcagctgtttctcacatctatagtgacaataaagcgggaagtataagatttaataggaggggttaaggttcatgagaaccatggaaagatgtggtctgagatgggtgctgcaaagatcataataaagtcatttttatagacagtctaaacaaaatgggtggggatgtcatgttttttgcccaattcagcttttgttctgcctgaacattaatggcaagtctagaactctccgaatcctacagctttgtaattttttttctacaaatgtctaacatccaaaactgagggttgggaaaaggacttccctcctgtagtttttttcatattacttctcactttatatcttatattctaaatagctatcacctcagcagtcttttgcctattggttatgttagtatcacattacttctagcctttcaattactccatgttttatttaatatccattgaagtctatgaattctctgttctggtggcacagctattcataacctatattctagagtagacaatctggactatgtaataaatagtctgctgattttaagttctctctctctctctctctctctctctctctctctgtgcgtgtgtgtgtgtgtttgggagaaatagaaacacttcaatttaagtagagctgctaaatttaattaaacttctgcttaagaaatgagttattttgagataaaagagggtagggtaaggaagcatctaagacgagaaagaaatgataaagtatgaaaagatttctagttgggacttgccttctattaactctttgaactgagaaacatccagtggcctgtgcatgacagtcactcatatgaaaggcagggtgtcacacctttcacagaaatgatagcaatactgtctaccatttactgagtacctagttggctaaagacactttacgtatgatcctcacaattactatatagtaggtgtaggcatacagataacaagtcaggaat

SEQ ID NO: 454252 - DNA, 2654 bp, Homo sapiens
atctctcggcttccgttgagcaccaagcaagatggcagcttccgagacggttaggctacggcttcaatttgattacccgccgccagctaccccgcactgtacggccttctggcttctggtcgacttgaacagatgccgagtcgtcacagatctcattagtctcatccgccagcgcttcggcttcagttctggggccttcctaggcctctacctggagggggggctcttgccccccgccgagagcgcgcgccttgtgagagacaacgactgcctcagagttaaattagaagagagaggagttgctgagaattctgtagtcatcagtaatggtgacattaatttatctcttagaaaagcaaagaagcgggcatttcagttagaggagggtgaagaaactgaaccagattgcaaatattcaaagaagcattggaagagtcgagagaacaataacaataatgagaaggtcttggatctggaaccaaaagctgtcacagatcagactgtcagcaaaaaaaacaagagaaaaaataaagcaacctgtggcacagtgggtgatgataacgaagaggccaaaagaaaatcaccaaagaaaaaggagaaatgtgaatataaaaaaaaggctaagaatcccaagtctccgaaagtacaggcagtgaaagactgggccaatcagagatgtagttctccaaaaggttctgctagaaacagccttgttaaagccaaaaggaaaggtagtgtaagcgtttgctcaaaagagagtcccagttcctcctcggagtctgagtcttgtgatgaatctatcagtgatggtcccagcaaagtcactttggaggccagaaattcctcagagaaattaccaactgagttatcaaaggaagaaccctctaccaaaaatacaactgcagacaaactggctataaaacttggctttagccttacccccagcaagggcaagacctctggaacaacatcttccagttcagactctagtgcagagtcagacgaccaatgcttgatgtcatcgagcaccccggagtgtgctgcgggtttcttaaagacagtaggcctttttgcaggaagaggtcgtccaggcccagggctgtcatcacagactgcaggtgctgctggatggaggcgttctggctcaaatggtggtggacaggctcctggtgcttctcccagtgtgtctctccctgctagtttaggaagaggatggggtagagaagagaaccttttttcttggaagggagctaagggacggggcatgcgggggagaggtcgaggacgagggcatcctgtttcctgtgttgtaaatagaagcactgacaaccagaggcaacagcaattaaatgacgtggtaaaaaattcatctactattatccagaatccagtagagacacccaagaaggactatagtctgttaccactgttagcagctgcccctcaagttggagaaaagattgcatttaagcttttggagctaacatccagttactctcctgatgtctctgactacaaggaaggaagaatattaagccacaatccagagacccagcaagtagatatagaaattctttcatccttacctgccttgagagaacctgggaaatttgatttagtttatcacaatgaaaatggagccgaggtagtggagtacgctgtgacacaggagagcaagatcactgtattttggaaagagttgattgacccaagactgattattgaatctccaagtaacacatcaagtacagaacctgcctgagtatgacctctccaccttatagtttatgaatgtcttgtttgtgaaagtgactataacccaaactttttttttttttaaagaggatttggaagttgtatggatttttttgttatcttcactttactgcataggaaacaatctacctcatcatttaaaatgacatgggtgtcggttttgtagatctttggtttttttgtcaggtttaatttcagttaacaaaatgtaaaacatgacattccctgcagatattgttgtataccagtatggtttcttctctttctttaaatgtttttggccatcaagtagcagtcgtcagtaggagtttataataccaagaatgtgctgcgtatcttgtctcaataagttttaagtaacatttaaaaatattaaagcatgttatttgacctaattttttagcatttgagttgttccattaaatggagcatcttgtaaatttcaagtattttatacttgcaattgttaagagttaacaggtagttggatttgtcgcagacaatgagttaaggaatcctttcacgtttttcccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaacatctctaccgagttatcatg

SEQ ID NO: 454253 - DNA, 392 bp, Homo sapiens
agcaattaaatgacgtggtaaaaaattcatctactattatccaggtaagtattattttttgtaagttatctcctccctttccccttagaatgtgtgtggagttcatgtcatggattcacattttctcaccagtgatgatgtcacatgactaacactgtttttcagaatccagtagagacacccaagaaggactatagtctgttaccactgttagcagctgcccctcaagttggagaaaagattgcatttaaggtatatttcaaaagaacagtcacagcaaaaaaggttcattccccttccaaataaacttacttagaaaatcaggttaaatgtgtttgtaaaagcccttcccactggaaccccagtgttgttacgggttcctggtagggctc

SEQ ID NO: 454254 - DNA, 326 bp, Homo sapiens
ccaactttaaaattaaggattctcaggtccctgtgtagagcagtgaaaataagatgtgcgtatgtgtgtgtatgcctggagaattggtgtttcacttcagtgagaggattggctgtgagcttcagaccaggaaatgtgtcatcttgccaggcacctggctgagtgtgctggagtgaggatcttgaacagaaacttccttttctgttattattcactacgaagctaaaatggccaaatatataccgtgaaaattggtttcatttaacaaaagatcagatccctccttcagctgtacacatttttaaataaaatcatattgaactaaa

SEQ ID NO: 454255 - DNA, 296 bp, Homo sapiens
ccctataactacactgattgtatacaatataaagacttttcctcctgtttaaatgagtagtaacattactatgaacaatcaaacagaatcattgctatataaaagtagctttattaatttttgtacatttcacagtgcctaacacatacatggttagtgtacaataaatgttaataattttatgattatagtgaaataaatagaacaaaaaactaaaggttttagtattcaaaggcagccagtgctaactcaaaatagaaactgtctcactcgttcacccaggctgcagtgcagtg

SEQ ID NO: 454256 - DNA, 628 bp, Homo sapiens
ctcccaaagtactgggattataggcgtgagccactgcgcctggctgatacatattatctttaataaaaattgtatatatgtatgcatgtacagatctgtgtatgcacatatacataaagcatttccatagtgaataagatggcttaggtttatggctttgaattaagtgcatgattatatcctggaataaagtaaatgttaattcatttattattttttcaaatctttatagaacattttaattgcactctccatttaaactgtttcaggatataaagtgacaaatgagctataacaaaacagtaggagcctcaaatgaaaaggagataaaacggcctaattcataacccactgattttgatctaggaaggccatttccaaagatctagtgctgtgtcgttaatcctggggaactaggttcttgcttactctgaaattatgttaataaaaactgtccagggattaatcactggacagtttttattttttcaaatagatgttgaaattctgatttacttttcttaccccgggaaagtatgtgtaagtggccttcctgtttcagtattgaagtactgttctctgaaatgattatttctgtcttcaacaacaaaagacaaatcttaaatta

SEQ ID NO: 454257 - DNA, 957 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454258 - DNA, 789 bp, Homo sapiens
gaaaatccaagtaagtctcctgtgtgaaagcgtaacaaaagatattttatttggggattttagattcctccctactattctttccgaccttccacccttactccctgcccgtgggattgtacttttagaggaaaacgacgttatctaaattgatccgctagtcaggttgcaaatgaatgttagaaagaacaattgaccccagttctgtaaaggttccgagtcctgggaggaggtgcagcgactgtgtgcacagcgccccctggtgatgagacactggcttttccgcatactaagagaagagcgtctccaacagagcggagtttcccagttgtataatgctttttgagacagtacctgtttcatcgaaaaagtgcctaataacacacttttggagacacttttcagacagagcgtttccagcatcttccctttccacttttaagttaagactttttttttttcacctctctcgttacttcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaaggtaatatgtgttgaaataccaagatatgtgacttaaagtcagttatttgagttctggaaagacagaaaccagtgatggttagaaagcacttgacatatttatttatttatttaataccatcttagcttgtctaggaagcattcaagaccatatacattcaacac

SEQ ID NO: 454259 - DNA, 769 bp, Homo sapiens
gctggtacggtccgggatttagggatctgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454260 - DNA, 718 bp, Homo sapiens
aggatccattagtgctcagatttagtttttagaagagagagaaaaaaggatacatatctagtattttgaaattagtgtctttaatagttatctttttccacaagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454261 - DNA, 596 bp, Homo sapiens
tccccgtacagagtgaatgtgtacagagtgaatgtgtacagagtgaatgtgtacgcagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaccttccctctgtaccgggatcctctaaaagtc

SEQ ID NO: 454262 - DNA, 1190 bp, Homo sapiens
gggcggtgcctgcgtccggcccgcgcggccacagtccctgcattgcgcgcgacccggcggcgggacaggcttgctgcttcctcctcctcggcctcaccgtgcgtactgggaggggagaaggggaccgcatgcaaagggtggcaggcagggagggccagggtgggtggcagatggaagacttgggggggtctctgccagctggaagtgcttggctccacttagcagctaaacttagcttttcaatcgatcgcttttgaaagggaattgtatttctgtccccgtgcgggtaagttttcccatttctcaaactccaggaatgaaacgagagagtcttttcatgcttgagtgatgatttccaaacttagccttttcaagtcaaagtaacctcctgtttgaaagggtcccttgaactctggggaaggaggaaaaggcacgtgtagtaatggaggaaatgcctgtagtttgaacgactgctgttctccccaagagtgcaaaagcctgcgatgtctcaggtttcatgggcatagtggcctttatgcctattgtaaggcaggatttgctcttctgagttcactttgataggagaaacatcagcaagttttaaaataatactaaataatactactgctaataatgctagctatcgaaacaagaggatgtgggttagatgataatatttttgtgtgatattatagccagtgacaagagagctaagggtgagccccttgggacggttctcacctgtgccccacttccccagtctggaggaggaagccatgtggaaggagaaaaggagaagggaactctctttttcgggaattaaggtgtcatatattgctctagctggcttgggacagaggagagaggagtgcatgtaaatcttctagtctctctgcttctcttgaaatgtggcagtctgagctccacgtttatattcccctatttcttctccctaatttcttacccagtgagtgctgagtgggtgcccgcaagcattgctgtatggcacccaggcctccagtgagcaatccttaaagcccagttttcctggggtcccagcctgctgtgagtcccagcctacacctaccttttgcatatgcttttcttggccttaggatagtactggactttgttgtcctctgctgtttccaaaataagagggctatgtgtgcgattatctttggtaattt

SEQ ID NO: 454263 - DNA, 856 bp, Homo sapiens
  misc_feature (695)..(695): n is a, c, g, or t
  misc_feature (702)..(703): n is a, c, g, or t
  misc_feature (709)..(709): n is a, c, g, or t
  misc_feature (716)..(716): n is a, c, g, or t
  misc_feature (718)..(718): n is a, c, g, or t
  misc_feature (722)..(722): n is a, c, g, or t
  misc_feature (739)..(739): n is a, c, g, or t
  misc_feature (746)..(746): n is a, c, g, or t
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagaggatggagtgcaatggcatgatctcagctcaccgcaacctctgcctcccggattcaagtgattctcctgcctcagcctcttgagtagctgggattacaggttgtgcagaagtcaagagctaaccaagaagacaaggaatgtaacatatttatcaaatagcacatcatctctattataagacagtggttgttaatactatcactgacagatattncgatttnnaacacnagcaatntnagtnagatcagcactttcttnagatagntcaattggttgctgaaaagaggataccagggttgattatgtctcaaatgggaaaagttggggaaagggggtgtaaatgggaaaaagcccaggaagggataacgaattgag

SEQ ID NO: 454264 - DNA, 550 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagagtaggttagcctgactgtgctatcacagcataggagcaagacaggaaatggaactgcataaatctcctt

SEQ ID NO: 454265 - DNA, 673 bp, Homo sapiens
cgatctaaggatcctactctcacccacccaatgctgcaatgtaagaacatcaaatgatcttccagttattttgggtatttatgtctgctttttcccattttatttaaatctttttaagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtaagaaatttggaggtaatattttcttacttttaagagttggaattctggagagcagttttcttaattttctttttttatttttggtaaagcccaatagcacactgttttatgctgtaagtgaagtatgccatcgtttggcacagatggatctgatgtatttatggaacagttgctttctcctagaaactagtaaatggttttttcattatggcttttacctttttatcattctgctaagcagatgagatattctggaatatcaaagttttcacggaaactttctttcattttggaattaattttgccaatgagggtttagaaaacaatcattttctagacagttaactggtattttcagctctagtgcaggtcaagggtatgattttggttaaaaaaaaatagaa

SEQ ID NO: 454266 - DNA, 308 bp, Homo sapiens
cctcctgggttcaagccactctccgcctcggcctcccaaagtgctgggactacaggcgtgagccaccacaccaggcctactgtttcgattttaagaatgaagaaatttagtctcagagactgaatccctcaagcaaggttaacagctaaatcgtgggactggaattcaagtcctaaagcctacagttttgaatactactgaaatgacaagttgtaagttgggtctccaaagcaggatacataagaactgagccttcctaagttcagtgctgctgctaggtacatagcttgatgtttccaaagagatca

SEQ ID NO: 454267 - DNA, 502 bp, Homo sapiens
cagggtcttgctctgtcacccagactagattgtagtggtgcaatcacagctcactgcagcctcaacctctcgggctcaggtgatcctccaacctcaacctcctgagtagctaggaccacaggcatgcatgtggcccactaccatgcaaaattttttttaaaaaaatttgtagatatgggtactccctatgttgcccaggctgatcttgaattcttgggctcaagcaatcctgcctcagcctcacaaagcgctggaattacaggtgtgagctattgctcctggccagtatttgaaataagttttttttcttggtatttggataggtttttgccaatccagaagactgtgtagcatttggcaaaggagaaaatgccaagaagtatcttcgaacagatgacagagtagaacgtgtacgcaggtaaaccagtgtctcttgaaattacttactttatgaaacaattttggtcaaggagttcagtgaagatgtctcagggtcttggag

SEQ ID NO: 454268 - DNA, 280 bp, Homo sapiens
gggggtgatcttgggtgagaatgctctcttctgctgagaacaactgccagaggactcaactgagcacctttaaccattagctgaggcttcttagcagtctgccatagcaactcaagtaatgcaactttactcagcatggaccgtcactttctccagacttctaagagatgccatagcagaaaatttatgcctttccctgcagtccttgtcaagtgttaaatcccatggccttatatcctgagaggatggctctaaatcaataaactctcctttatctagt

SEQ ID NO: 454269 - DNA, 1042 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatgagaatatcccacttcacatacctaaaacacccaagggggggccccggtccccaattcgccccaaactgaagtcgacttacaattca

SEQ ID NO: 454270 - DNA, 881 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaccttccctctgtaccgggatcctctaaaagtc

SEQ ID NO: 454271 - DNA, 1145 bp, Homo sapiens
gggcggtgcctgcgtccggcccgcgcggccacagtccctgcattgcgcgcgacccggcggcgggacaggcttgctgcttcctcctcctcggcctcaccgtgcgtactgggaggggagaaggggaccgcatgcaaagggtggcaggcagggagggccagggtgggtggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454272 - DNA, 1154 bp, Homo sapiens
  misc_feature (113)..(113): n is a, c, g, or t
  misc_feature (117)..(117): n is a, c, g, or t
  misc_feature (128)..(130): n is a, c, g, or t
tcgtcgtcgtcgtcatccatcgtcctcatcatcctcttcttcatcttcatcctcagccacagttcttggctttcacaggaacaacttttgcagctttctttcctttggctggngtantctccatagcnnnttcttcagagtcatcttcctcatcgtcatcgtcatcctcatcatcttcgtcatcctcatcgtcctcatcctctgaggcaggggcagcagctgctgctttcatcgctgctggttcaatttcatcttcatcctcatcctcgtcctcgtcatcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454273 - DNA, 1034 bp, Homo sapiens
cagggtcttgctctgtcacccagactagattgtagtggtgcaatcacagctcactgcagcctcaacctctcgggctcaggtgatcctccaacctcaacctcctgagtagctaggaccacaggcatgcatgtggcccactaccatgcaaaattttttttaaaaaaatttgtagatatgggtactccctatgttgcccaggctgatcttgaattcttgggctcaagcaatcctgcctcagcctcacaaagcgctggaattacaggtgtgagctattgctcctggccagtatttgaaataagttttttttcttggtatttggataggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454274 - DNA, 862 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454275 - DNA, 1013 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaagtacagaattcttaaaaagccaattggaggtagagtgtatggtgtggatatggagtaactactataactatggattacaagttgctgacacagtagattgtactggtaaagaaatctaccaattagggatcaggtggtttttggaatttgtacttcaattatatgaatctttttcgattgcgtagagggaccatttatttagctgggtaaccctttgaatatgttggcaaatcgagtttgtcattggttaaatacataatctcataggcaaaaattatatggattgtagagaacacctttctta

SEQ ID NO: 454276 - DNA, 1101 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454277 - DNA, 1050 bp, Homo sapiens
gggcggtgcctgcgtccggcccgcgcggccacagtccctgcattgcgcgcgacccggcggcgggacaggcttgctgcttcctcctcctcggcctcaccgtgcgtactgggaggggagaaggggaccgcatgcaaagggtggcaggcagggagggccagggtgggtggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454278 - DNA, 1241 bp, Homo sapiens
gaaaatccaagtaagtctcctgtgtgaaagcgtaacaaaagatattttatttggggattttagattcctccctactattctttccgaccttccacccttactccctgcccgtgggattgtacttttagaggaaaacgacgttatctaaattgatccgctagtcaggttgcaaatgaatgttagaaagaacaattgaccccagttctgtaaaggttccgagtcctgggaggaggtgcagcgactgtgtgcacagcgccccctggtgatgagacactggcttttccgcatactaagagaagagcgtctccaacagagcggagtttcccagttgtataatgctttttgagacagtacctgtttcatcgaaaaagtgcctaataacacacttttggagacacttttcagacagagcgtttccagcatcttccctttccacttttaagttaagactttttttttttcacctctctcgttacttcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454279 - DNA, 677 bp, Homo sapiens
ctccaagatgggatctctgtgtctgacattcactctgtactacagagtgaaatgtgtacgcagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454280 - DNA, 669 bp, Homo sapiens
cgtccaacggtacgggcaaggaaccacaaatacaattcataatagttccagtaagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454281 - DNA, 898 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454282 - DNA, 808 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454283 - DNA, 1047 bp, Homo sapiens
gggcggtgcctgcgtccggcccgcgcggccacagtccctgcattgcgcgcgacccggcggcgggacaggcttgctgcttcctcctcctcggcctcaccgtgcgtactgggaggggagaaggggaccgcatgcaaagggtggcaggcagggagggccagggtgggtggcagatggaagacttgggggggtctctgccagctggaagtgcttggctccacttagcagctaaacttagcttttcaatcgatcgcttttgaaagggaattgtatttctgtccccgtgcggattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagctattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgtga

SEQ ID NO: 454284 - DNA, 761 bp, Homo sapiens
  misc_feature (600)..(600): n is a, c, g, or t
  misc_feature (607)..(608): n is a, c, g, or t
  misc_feature (614)..(614): n is a, c, g, or t
  misc_feature (621)..(621): n is a, c, g, or t
  misc_feature (623)..(623): n is a, c, g, or t
  misc_feature (627)..(627): n is a, c, g, or t
  misc_feature (644)..(644): n is a, c, g, or t
  misc_feature (651)..(651): n is a, c, g, or t
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaagggcacaggagatcttaggcccagaaaggcagattcagaagaacctacatgtaaatgagactggagtggaaatgagaatggcaggaaatgcatggaaacagacttgtaactgtctcatggcctggtcgtccaaatcccagaggatggagtgcaatggcatgatctcagctcaccgcaacctctgcctcccggattcaagtgattctcctgcctcagcctcttgagtagctgggattacaggttgtgcagaagtcaagagctaaccaagaagacaaggaatgtaacatatttatcaaatagcacatcatctctattataagacagtggttgttaatactatcactgacagatattncgatttnnaacacnagcaatntnagtnagatcagcactttcttnagatagntcaattggttgctgaaaagaggataccagggttgattatgtctcaaatgggaaaagttggggaaagggggtgtaaatgggaaaaagcccaggaagggataacgaattgag

SEQ ID NO: 454285 - DNA, 930 bp, Homo sapiens
  misc_feature (799)..(799): n is a, c, g, or t
  misc_feature (801)..(801): n is a, c, g, or t
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagtcattgtaaagctgttacgattagcatatttgaacggcagagccagaatggggctacaaatgaagtgaaaagtatgctttaccgtgtgcaacaattgtgaaagttaatacatacacatatggaacaattaactaaaaacttaagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatatatgatactntngattaggggggggccgagattgaagggtaccctgataagtgcacacgttccgttaatgttgagacaacattatgtgtaaaccttaaggagtgtaaccccctgaaaacgaaatccgacgaaaaaatcgtc

SEQ ID NO: 454286 - DNA, 654 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagacggagttttgttcttgttgtccaggatggagtgcaatggcatgatctcagctcaccgcaacctctgcctcccggattcaagtgattctcctgcctcagcctcttgagtagctgggattacaggttgtgctctgccatagcaactcaagtaatgcaactttactcagcatggaccgtcactttctccagacttctaagagatgccatagcagaaaatttatgcctttccctgcagtccttgtcaagtgttaaatcccatggccttatatcctgagaggatggctctaaatcaataaactctcctttatctagt

SEQ ID NO: 454287 - DNA, 1131 bp, Homo sapiens
  misc_feature (968)..(968): n is a, c, g, or t
  misc_feature (1106)..(1106): n is a, c, g, or t
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatgaaaaaaaaaaanaaattttgacaaaaaacaaacatgtcggaccgcttggcccaatcggatttaggatttaacaaacttatgcatcccggccggattggagctcacttgggccattcgccctatagggaagggttttccaatccactggcncggcgtttacaacgccggacttggg

SEQ ID NO: 454288 - DNA, 1330 bp, Homo sapiens
caataacccattaagttagaagctattactatttcaatttttttttttggagggggagacagagtctcactctgtcacccaggctagagtgcagtggtgccatcttggctcactgcaagctctgcctcctgggttcatgctattctcctgcttcagcctcccaagcagccgggactacaggcgcctgccaccacacccggctaattttttgtatttttagtagagacggggtttcactgtgtcagccaggatggacttgatctctcgacctcgtgatccacccgcctcggcctcccaaagtgctgggactacaggcgtgagccaccacaccaggcctactgtttcgattttaagaatgaagaaatttagtctcagagactgaatccctcaagcaaggttaacagctaaatcgtgggactggaattcaagtcctaaagcctacagttttgaatactactgaaatgacaagttattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454289 - DNA, 951 bp, Homo sapiens
cagtacaattgcctccaatttcattctggaccctgaacaggaggggacatcgtgacaaagcaaattgtctggtatcatgaatttggaacaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454290 - DNA, 958 bp, Homo sapiens
gtccccactcgacccaggaagtccagctggcttcacctctcaccaggccctgttttaagcactgtttatttatttaatcatgacaaaaatccccatgagattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454291 - DNA, 812 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagaaaatcatacaactcagcatccagttggctttttaagaattctgtacttccaatttataatgaatactttcttagattttaggtaggaggggagcagaggaattatgaactggggtagtcgtgccatattaccgcttccaatactctgctattcgactctagcgattgcactagtgaacgaataagagatgttgagatgatcgtgctgtatcgattacagct

SEQ ID NO: 454292 - DNA, 903 bp, Homo sapiens
gggcggtgcctgcgtccggcccgcgcggccacagtccctgcattgcgcgcgacccggcggcgggacaggcttgctgcttcctcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagagcccacctgaatgaccttgaaaatattattccatttcttggaattggcctcctgtattccttgagtggtcccgacccctctacagccatcctgcacttcagactatttgtcggagcacggatctaccacaccattgcatatttgacaccccttccccagccaaatagagctttgagtttttttgttggatatggagttactctttccatggcttacaggttgctgaaaagtaaattgtacctgtaaagttataatgaatactttcttagattttaggtaggaggggagcagaggaattatgaactggggtaaacccattttgaatattagcattgccaatatcctgtattcttgttttacatttggattagaaatttaacatagtaattcttaagtcttttgtctgatttttaaagtactttcttataaatttggatcatgttatgatttgtaacattcacacaacacctcacttttgaatctataaaagaattgcacgtatgagaaacctatatttcaatactgctgaaacagacatgaaataaagaatttaaagaatga

SEQ ID NO: 454293 - DNA, 1056 bp, Homo sapiens
  misc_feature (113)..(113): n is a, c, g, or t
  misc_feature (117)..(117): n is a, c, g, or t
  misc_feature (128)..(130): n is a, c, g, or t
tcgtcgtcgtcgtcatccatcgtcctcatcatcctcttcttcatcttcatcctcagccacagttcttggctttcacaggaacaacttttgcagctttctttcctttggctggngtantctccatagcnnnttcttcagagtcatcttcctcatcgtcatcgtcatcctcatcatcttcgtcatcctcatcgtcctcatcctctgaggcaggggcagcagctgctgctttcatcgctgctggttcaatttcatcttcatcctcatcctcgtcctcgtcatcctcctcggcctcaccattccagaccaaaattgaaaaaatggttgacctcacccaggtaatggatgatgaagtattcatggcttttgcatcctatgcaacaattattctttcaaaaatgatgcttatgagtactgcaactgcattctatagattgacaagaaaggtttttgccaatccagaagactgtgtagcatttggcaaaggagaaaatgccaagaagtatcttcgaacagatgacagagtagaacgtgtacgcagaatcaaacaaaccctgagcatttatcttgcctcttctatataaagtttaactcggcataaccaattgctgatgaagaagaaatgtttccttgtagaagcaaaccagtgaataattgaagaaaaaatttatcttttcaacatctaatgagttaatggattcaagcaaagattatccacggctgttaacaacacaaaaagacaatcggaaattagctattactgcgggaagtacccaataccatctatgaaactgtgtggacaaaaacactgacaaaaatctccacgaatctctaattttgaatacaaatttaaagaaaatgcaaaggattaaaatagaccatgatgaagtcagaaaaattcagacagagaaaaatgctccaggaccagaaacccatttcttccgcaaaagcttccaggtagagattgactgaccgagagaacagagacatagagagaacctagagattaaaagaaacttgagcgatttgtcagcattcagttgcaacgtatggatgtga

SEQ ID NO: 454294 - DNA, 2830 bp, Homo sapiens
cgaagcacattttaatcatttattttaaaagggggagtaaagcatttaaactgccaatcctatagactaggacttgaacatcaaaggaaaaatagacaaagactagatgataaagtcattcaaaagcacagaagcacatcacatacaccagcaaggtttccaactactgcactgattaactagatactctcaatagcttttctatagctcgtcctagaaaaaaaaattaaattttcattttcttacaagttccaggcttaaacaaaggcaaaaattacatgcaacaactgatacactcataagttgcacatatgctccaaggtctttattagataacaataaatgctagcactttgtcactgccatcagattttcttatagtcttagagtcatgtaaataaaagttcataatgaaattaaagaaaattaatttttctaatcttagatcagttccatagaaaactattaatttttttaaagtaggcagtagaagggggttggtggggggtggaattggttagtaagtctggttctaatcttctgagctgcctttggaaggaagttatgaggtagaagattctactgacttttagtaaggtggacaatgagagaaaagaaaaagcaggtgcctcatctacagatccttctgggatttatttgccatgtacaatttaatgcataaaaaggcctctctccataaaactcagcactttacagatgtagaatatataagcatgccaaatttacttatctgccacatacaaagcatcattccaggtgctagtgaggggaaaaaaaagttggagatttggtccctcgaggagctccagatattaatctacctaactaagtccccaggtttcttccaggcatggaagaattagtggtgctacatggatgaggactagtcattgggcaatatttcctgtacaaagaatccctatacgccaaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcagatatctaagtaagtggagaagactattttttcaacaaacattttctctttcaccctaactcctaaacagcttactggggcttctgcaagacagaaagatcataattcagaaggtaaccatcgttatagacataaagtttctggtcaaaagggttatagttaatgctctgcactttttcctgcatcttatgcattacaatgtctagtttgccctctttccctgtgtttgtgtcataatagtaaaaaatctcttctgttctggtgttcatagtacgggtggcatacagaaccccacataccatgaaggcgttagaagcagatggtttatactgcttggtataccaagtgtttagcacctgaagtgtggtgtcattgagtttactaatcaccatgttaaccagtgctggcttcagttgaataaataacccacaatccattctcatccacagcaaagtcaatatgcttgccaagcaacattagcatatgaaaagcggttattataggcagcattagggagagtttgagtcacagcaatcgtgttggtggtcaggttaactctggcaatattcccggtgtgtacatgttgacgtacatgttgttgttgtaaactgctgtaccactaccttggccataggtgatccgcaactctcgagcatttatatacaatagcaaatcatccagtgtgttgtacagtatataatactccaacagtctcccatctgtattcaatggcgccacccaatacagtcctttgtttggatgctggggagagtaatccctaccccaagcaccatatagataagaaaaccctctccagttgagctgaaccacagacggtttgctgatgttcaccacaccaccatgaccacagctccctggagtgggaggagggtggacgacaggggtgttttgatctttagaggcctcacactctttcagcttggtcttcagagccacgatttctcggcgaatggcaaggacattgtttttgtctagtgtctcaagcttctctaccaagagagtcatatttcttatctccacctccagctggtcaacaatttctgagcttccaccaaaactctccttcagctgtatgaccagtttttccatctccttcacttctaccttatcagctcgaagtccagttcagtgtaagaaatgtatccttctcccatgatgtcaattcggacagttaggtttaacagtttcttttcatacaaactaattaattggacatattccctcactttggaaagttctttctcaaacttctgagaaagaacatgagctgtgaattccaagcgttccactctgtccacgggaaaggtggtgtctggcagggaaacagagcactggcaggtcccacggtcatccacggagccggtgaaattggaaaacaactgggacacagaacctccgctgcctaagctgcggctggagctggagcccgacctggagctggagctgaagctggagctggagtcaacacctgggaaagagctgaagccggggctgggaattggaggtcccacatcccccaaatcccctgcagcttggccaaggaagaacagaagggctaggagaaatgagaggccgacctgcccgggcggccgctcga

SEQ ID NO: 454295 - DNA, 2825 bp, Homo sapiens
aggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454296 - DNA, 1074 bp, Homo sapiens
  misc_feature (64)..(64): n is a, c, g, or t
cgcgccaattaggtgcatgagtaggtggctgcagtaatgttagcggttaggcgtacggccaggncatatggttgaatgagtaggctgatggtttcgttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454297 - DNA, 864 bp, Homo sapiens
tccctctagtatgatccccatggatagcggatgaggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454298 - DNA, 1674 bp, Homo sapiens
cgaagcacattttaatcatttattttaaaagggggagtaaagcatttaaactgccaatcctatagactaggacttgaacatcaaaggaaaaatagacaaagactagatgataaagtcattcaaaagcacagaagcacatcacatacaccagcaaggtttccaactactgcactgattaactagatactctcaatagcttttctatagctcgtcctagaaaaaaaaattaaattttcattttcttacaagttccaggcttaaacaaaggcaaaaattacatgcaacaactgatacactcataagttgcacatatgctccaaggtctttattagataacaataaatgctagcactttgtcactgccatcagattttcttatagtcttagagtcatgtaaataaaagttcataatgaaattaaagaaaattaatttttctaatcttagatcagttccatagaaaactattaatttttttaaagtaggcagtagaagggggttggtggggggtggaattggttagtaagtctggttctaatcttctgagctgcctttggaaggaagttatgaggtagaagattctactgacttttagtaaggtggacaatgagagaaaagaaaaagcaggtgcctcatctacagatccttctgggatttatttgccatgtacaatttaatgcataaaaaggcctctctccataaaactcagcactttacagatgtagaatatataagcatgccaaatttacttatctgccacatacaaagcatcattccaggtgctagtgaggggaaaaaaaagttggagatttggtccctcgaggagctccagatattaatctacctaactaagtccccaggtttcttccaggcatggaagaattagtggtgctacatggatgaggactagtcattgggcaatatttcctgtacaaagaatccctatacgccatgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454299 - DNA, 741 bp, Homo sapiens
acacagcgtacgaccatgactggcgaacttcgagcatcacaacccatagctaggatcatgatttcctatcaaagatcaggaattctcccaagaagaagcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454300 - DNA, 2320 bp, Homo sapiens
tcctgaacctcctggggcagttcacacgttccctggccactccctcttttcctacatgctggccatggggaaatcaccactgggcactataagaagcccctgggctctctgcagagccagcgctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454301 - DNA, 2745 bp, Homo sapiens
aggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagagtgtgaggcctctaaagatcaaaacacccctgtcgtccaccctcctcccactccagggagctgtggtcatggtggtgtggtgaacatcacatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttcatatgctaatgttgcttggcaagatattgactttgctgtggatgagaatggattgtgggttatttattcaactgaagccagcactggtaacatggtgattagtaaactcaatgacaccacacttcaggtgctaaacacttggtataccaagcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatggacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaagtcaaaaat

SEQ ID NO: 454302 - DNA, 1236 bp, Homo sapiens
  misc_feature (282)..(282): n is a, c, g, or t
  misc_feature (537)..(537): n is a, c, g, or t
  misc_feature (558)..(558): n is a, c, g, or t
  misc_feature (586)..(586): n is a, c, g, or t
  misc_feature (637)..(637): n is a, c, g, or t
  misc_feature (647)..(647): n is a, c, g, or t
  misc_feature (658)..(658): n is a, c, g, or t
  misc_feature (665)..(665): n is a, c, g, or t
  misc_feature (667)..(667): n is a, c, g, or t
  misc_feature (676)..(676): n is a, c, g, or t
  misc_feature (740)..(740): n is a, c, g, or t
  misc_feature (769)..(769): n is a, c, g, or t
  misc_feature (1095)..(1095): n is a, c, g, or t
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcagttctgggacgactgcgtttagtacgcagagtgccgcggaagtatatgagaagagcaagtaacagctcgtgctcagagacacttcgtgcccantcgtgaggatagacggaggagctctcaagcatcatctgctctacgttagtccctagtactaggtgacgaacaagtattccacaagctgcgtcggacgtctgtagacaccagagtcacgcctaatcttttgctgacacggaacgtctgtcatcacgttgagcggaatgccctgcgtgatgcgggacaggtggcatgacgccatggacatgcatattggagcgaccagagaaccgtgcagacagctggtacatagcncacaggtgcgctagtagcaanatgtaagattacatgcccaattgcgccncggatgtacaactctcagggggcactctgggcgtggtatgttggcttgggncacaccaganatgtacggcgnccctagngnagagctganacatgactactaggcatattggactttgtctacatgcagatacgaacacaagtcacaagcgagngtacagtatctcacatgagcgcataacgnatgcgcatacgcactagtcgagaaactggactcgcatacacttcgtagtcgcaagcgtcagtttccacggcgaagacgcactcaccaaatagtgcacactcatcgccttacaattcgaactgtggactagatgcgagccagttatttgcgcacggtacatgtgactgtgagcgaatggctctcatactggtgcgcactttagaagatacatcgtttgaccatccagacggaggtctaatcattgtggctgagtggtgtcacgcgagtaccccatgactcgcttaatcatacttgacggaaggcaccgagacttgtcattgacattntctgcacaacgcgaagcacgacctgccaagtccttcacaaccattcttactccacatgtcttacacccactacttttacgacatcacgcagtcctacggctgcaaccaagtcattggctagactatattggagcgaaggac

SEQ ID NO: 454303 - DNA, 323 bp, Homo sapiens
  misc_feature (11)..(11): n is a, c, g, or t
  misc_feature (24)..(24): n is a, c, g, or t
acgtccatggntgttttttcttgncaacagtcttcaaacttagaattctttgtggataaattgtcacagagttttactgtgtgttcagggattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454304 - DNA, 1714 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454305 - DNA, 2088 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaaaaaaaaaacaaaacaaacaaacaaaactgtgtgggcgcactagggacccagaaaaagcttccgaagaacacacgggaggagacacagggcccaaaagatacgcgaaccgtggcacaacagcaggctcccaagagaaaacaccggggcacaagacagaggcgcctgggatctccccgccaagataaaagagccccgcggggacaacacagacggttcctgtaacaacatcacgaagggcacgtggcgaagaccacacaggggaccgtaacacaccaaggcgaccccagcgagagacagaatcacaaac

SEQ ID NO: 454306 - DNA, 1752 bp, Homo sapiens
tataaatcattcgtgttggcgctctggcacagaaggtgtgtgaacatggtcttagctgtatcctaggacgatcctgcgttgcatgcatcatcatgtcgtctgtgtggatgtgctactatccgaaataatagacatatcgaccacgagcagggaagccgatcgtgactgagacataaatcgcagtagtgagaggtatctgcatgcgtcatctagcgtggatctagtcactcacggattctctggtcgagcatctcactgtcacaagttagcagccatcgcccctgatggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454307 - DNA, 1212 bp, Homo sapiens
aagaagaccgaccccagcggccccgccgccccccccgcccccccccccaggactactatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454308 - DNA, 1728 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcatcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454309 - DNA, 1727 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaacccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454310 - DNA, 1735 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaagaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454311 - DNA, 1648 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454312 - DNA, 1239 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactataagcaggggggggggccccccttttttcccccccc

SEQ ID NO: 454313 - DNA, 1184 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcaggtaaagattaagtgctattgtcatatttagatgtttggttctgcactgtctatccataatattagggtttttttaagaagctgtctatattgaaagatataaaatagacttttcagctccaataatctccaaaaatctggccaaattctcgttttcttttctctatacagattatgaaaaataaggaaaaagtttatgtcataaaacatgagatttgcttttaatcaatcttttccatatagttgaccactagaaaatattttttcagtgttcatattagcatatgttacaaacaaaaaagcaaaacaagaacaaaaacaaaccaaaaaa

SEQ ID NO: 454314 - DNA, 410 bp, Homo sapiens
aaaaaggcattaagctggtatgaggtcctgtaaaggaaatattctttaaggaatttgaaatttaaaactgaagagaaggtgaaaggttaggataaaatagaagaggtactcttccattttgaaataatgagcaaatgaaagaagactggacttccaattcagcagcgatttgtatgtttatttttatgatctcgaagaggcatgtttcactttctgatctcaaattgactattctataccacaggtatagaattttcttgagacaggcaagtatttctattttcatttttattgtaaaagatctgaaatggctattattttgcattagaaatttgtataaaataaatacatgtagtaagaccttacatttaaatggtttttcagactggcagagcgactaaaagcaaaat

SEQ ID NO: 454315 - DNA, 398 bp, Homo sapiens
tggcaaagctggttaacaagcgctcagactttgcctccaactgctgttccataaactcacctcctctttactgtgattcagaggtaggaaaatgtaaccctccacttaacatggcagaatcttttaagaacgtatgcactccaatctactcatttctttcctgttattgagatgccattatgtgacaggcttttcctggtgttattgtaacttggctgtctttgcaatgaaagtaagaaacataactgatttcatgctatgctcatttaaaagcaagttgaggtagttgtaaaacttaggaaattttatactttttttaagaaacaaaagagtctgtgaacacaggcaacaaagtatgtgtagtgttttacaaattgtgagttgtaacctagtaacag

SEQ ID NO: 454316 - DNA, 683 bp, Homo sapiens
ttcaagattttgtataccttctgcatgatctagtagcctacaaatgaaatacttcataagttatataacattcttttttcattatcagattgatgctgaattgaagaatatcctgtagtcctgaagcatgtttattaactttggtaagtatattttataaatgcaggaccaacggatccagcattgtaggatgtattttaaatatcaaagaatgggaaggagactttaataaatttattcttatctgttcaaactcattttacagatgagaatattaagcaccgagaaaagttaaagagcttacacttatacaagagcagccaatttctgatatatgtaagactagaatccaggtttactggtcccctgccttgtgcttcatccatcataatctcacatgtaacataatgataccgtaaagaacatttaaaggattctgatgcacttcaataggaagaactctgagtttaaagacagggctcatcaagtcttaaaaataacacagcaaggaccttaggaggaaagggacattcttattcaaatgaaaacaatactgttgaaatattattacttgcttttttcagtcactatattttcacctattaaaaaatgccagatgaagatattaagaacataaaatagtttattccaacgtaagttcacatcttaaactgaagagcacc

SEQ ID NO: 454317 - DNA, 1781 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454318 - DNA, 1771 bp, Homo sapiens
aaatataacagaatgtcataaaattgtggcctgttatgagagaagagctagaaaggcccccaaaatatgaaattgcatatagacattgagaaaatacgactttcattgtaggccacgtggaagatcactttatacatgtacatgtaacataatattcatcaaaaggggacacatacaaatttttctatttctgcctcctaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454319 - DNA, 1723 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccagggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454320 - DNA, 1213 bp, Homo sapiens
tctctacataatttatcatctataacacatacgctctcccaaccacaaaactttcactatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454321 - DNA, 1728 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaactctagctacaatatcttcatacaatgacaagtatgatgatttgctatcaaaataaattgaaatataatgcaaaccataaa

SEQ ID NO: 454322 - DNA, 1727 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcgctcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454323 - DNA, 1676 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaa

SEQ ID NO: 454324 - DNA, 716 bp, Homo sapiens
ttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactc

SEQ ID NO: 454325 - DNA, 851 bp, Homo sapiens
ttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaatcccaattatttttcaccccatgggtttctcgaaaaaaaaaacaacaaaaaaattgtgggccgggccgaaagtttaacatgttgggggccgggaggaagtgcggtgccggaacgggcgaggggttccaaaacgggcgggtggacaaggcgggtgggtcggcggagcccgcgggg

SEQ ID NO: 454326 - DNA, 911 bp, Homo sapiens
ttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttttgtgtattctcagcttatctaaacttaatgaaatttcttttatatttaaaaatagtacattctgtctcatgtcacatatcagtagatcaattagtatttccttgtgaacaatgttatttataaagaactcattatcaataataatt

SEQ ID NO: 454327 - DNA, 762 bp, Homo sapiens
ttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatc

SEQ ID NO: 454328 - DNA, 348 bp, Homo sapiens
ttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagatggagtcttgctgtgttgtcacccaggctggagtgcagtggcatgatcttggctcactgcaacctgcacctcctggattcaagca

SEQ ID NO: 454329 - DNA, 2118 bp, Homo sapiens
ttccggcctttggcgctctatgacgtcaccgaagtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgagggtcccctggcgatggcagaaatgaaccctgcacagggtcatgtggtttttgaagacgtggccatatatttctcccaggaggagtgggggcatctcgatgaggctcagagattgctgtaccgtgatgtgatgctggagaatttggcccttttgtcctcactaggttgttgccatggagctgaggatgaggaggcacctttagagccaggtgtttctgtaggagtgtcacaggtcatggctccaaagccctgtctatctacccagaatacccagccctgtgagacatgtagctcacttctgaaggacattctgcgtctggctgagcatgacggaacacaccccgagcagggactgtacacgtgtccagcacatcttcaccagcaccaaaaggagcagattagagagaaactttctagaggggatggaggaagaccgacatttgtgaagaaccacagagttcacatggcagggaagaccttcttgtgcagtgaatgtgggaaagcctttagccacaaacataaactttctgaccatcagaaaatccacactggagaaagaacttataagtgcagcaaatgtgggatattgtttatggaaaggtccacactcaatagacatcagagaactcacactggagaaaggccttatgagtgcaatgaatgtgggaaagcctttctttgtaagtctcaccttgttcgtcaccagacaatccactctggagaaaggccttatgagtgcagtgaatgtgggaaattgtttatgtggagttccacactcattacacatcagagggttcacactggaaagaggccttatggttgcagtgaatgtgggaagttctttaagtgcaactcaaacctctttaggcattacagaattcatacaggaaaaaggtcttatggttgcagtgaatgtgggaaattctttatggaaaggtctacactcagtagacatcagagagttcacactggagaaaggccttatgagtgcaatgaatgtgggaaattcttcagcttgaaatccgtcctcattcaacaccaaagagttcacactggagaacggccttatgaatgcagtgagtgtgggaaggccttccttacaaagtcccacctcatttgtcatcagacagttcacactgcagcaaagcagtgcagtgaatgtgggaaattctttaggtataactctacacttctcagacatcagaaagtccacactggataaggcccttatgaatgcagtggatatgggaaagccttcagtcaccaacatattgtggctggacagcaggcagtacacactggagaaagactgaatgccgtgaacgtgggtaattatgtaggtacagctctccagtcgctatgtatcagagaattcacactgcagaaatgtgtgttcagcaaactcgggacattattttggtttgactctcatctcattagacattggagagtttacactgaagaagagtcttttcaataaagtagaaagtggtaaagattcaacatgcaagattgtacttattgggcttcagaatatccacactagtgaaagtcttctgagtacagcaaatgtgtgacattattttgctactactccacactacttagacatcatgtagttcacactggaaaaaggccacgtatgtgccttgaatgtagccaaaatgatgaacaacacccagaaatctgtgatttagcactgagaactagtattatatggtttttaaaaaacaatggtgaagtacatgccacataaaatttgccatcttaactattgtaatgtcttgtttaatacttgaagtacattaacattgttgagcaaagaatatcctgaactctttatcttgtaaaatgaaactctataaccaccattaaaaaaacaactcattccca

SEQ ID NO: 454330 - DNA, 1028 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454331 - DNA, 617 bp, Homo sapiens
gcgatggtcccgcctggccgggcattccagcctgtaccggtgcccccttctccttgccaccccggtgtcctggatcatcctctcaggtgggtcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454332 - DNA, 614 bp, Homo sapiens
  misc_feature (537)..(537): n is a, c, g, or t
  misc_feature (610)..(610): n is a, c, g, or t
ggaataaatcatctcagagtggctcgcgttcttatttaagcagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggtcatctgaaccgtgagactacctgctggncggacttcatcctgagatggtgatggctcgctttggtatatactgtcaatgtaccaggatactaatgcatttntctg

SEQ ID NO: 454333 - DNA, 773 bp, Homo sapiens
ctgacgtttctataaagtaggtcataagaaccttcattccagaagtaccctcaaagacagagacaccaagaagaatcggaacatacaggctttgaggaaatgtggggctatggagcagcaaggagacacacaataaattttacagagaaacctgtacctctttgcagtcaaataaatcgactgacagaccctgaataaacacagcttaggttttcttagattgctcttatcctggctatccaagaatgttgcaacacctttaaattttaagattaagttgtcattgtcagttcttataacagattttcttactcttaagtttatgggagaggaggagaatataggataatgttaatttctctgccacacagctctgctttcttaataattcagactctctccatccagggaaaaaatgaatacctaatgtgagtatatggaatcctgacccagctttcagattgagagagtctatgaatcatcacatttgatgtttatgattcaaaatgtaggattgccttaaactaaggcaattaggaagatagtttttcagagacgttagtctttgttaagatttctaggtccccataagagcacttagtcagataattgctaaagcacatatgtggctctaggaactaaggaaaaagtaaatgccataggaagactattttttaaattacctcattcatcagtctattgtaagagacagcaaatttgaaactaaaggtcacaggctgctttagatgcatggacttaaaaattagagaaag

SEQ ID NO: 454334 - DNA, 1356 bp, Homo sapiens
atccttattctatatctcttggtatttagtgtaaaaattttaaaatctttacctagcaatcttgaggaagaaacttgataactgataatacatgagattgttacctaagtgaaatataatcctatatattcaacaaactttagagaaataagataaattttaaagtaaatgacttctgtagttttatagatcctccaaaccaatctagtctcagatctcaccttcatcatttctctcatttccttttggcctaattaatcaaaatccttcctagaatgttcatttctggccagtatgtcttcctgaatatgaataagaaataaaataccatttgatgtttgaaattatgggggtaatctcaatgacggaaatagatgaccaggaaaagggaaacgaatgcctgattcattatattcatgaagatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454335 - DNA, 1118 bp, Homo sapiens
  misc_feature (1067)..(1067): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaaaaagacttcacttaatgggccgggcgcagtggctcatgnctgtggtcccggcactttgggaggccgaggcaggcggatcaggaggtcagg

SEQ ID NO: 454336 - DNA, 1279 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaaacaacaggggggcgcggtacccattggctaaatggattgttaacatcatggcggcgtaacacgtctgacggagaccgggtaccactaatgctgagaatccctttgagcgggatacaaaggggcgaatgcactaaattggcagaggatggaggaagaaatgtaaagctattggaagaatataaaagaggaccttatgaaggggggtggacggatgcgtcttttgtcttagatggggtgttggttgtgggggg

SEQ ID NO: 454337 - DNA, 1217 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaaaagagaaaaatgaaggggggcggaaccaatgcgcatatgagcgataaaaaagggacgctaaaaacggaggggaaccgggtgcacaaaagcgggacacccaagagagggaaaacaggaggataatcacaagagacgaggagatgagaaattaacgcatggctacaacggccaacaggggcgccacccgct

SEQ ID NO: 454338 - DNA, 1281 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaaggggaagagtcataattctttggaaaataaccatgaatacacttacagttaggatttgtggtaaggtagctctcaacattaccaaaatcatttctttacaggggaagggatatcattcgaatgaacttttaagaaggaaatttcaggcgcggagttaactggggttatttctaataccaaaggggattatatgaaacattaatgggagagctcagggttcaataccacaggtactccctggttgcggggtgtt

SEQ ID NO: 454339 - DNA, 1098 bp, Homo sapiens
  misc_feature (1067)..(1067): n is a, c, g, or t
  misc_feature (1097)..(1097): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaagctatagctgcatccgaggtgctggtggacaacgcgganggggtccctcgcttgcggcggcggcttggnc

SEQ ID NO: 454340 - DNA, 1096 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctctaagataagacgggtcctgagactctaagcgaaccggaggggaacgcgcgcaatatgcgggatacccgcagagggagcgcagcccacgcgacacgagggatgcctgtac

SEQ ID NO: 454341 - DNA, 1158 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttttggcacctctttaggggttcctttgaacccacgtgggttaacggctccctcttaattaaactccctctgaccaactcgaccaagcaccggcacacacccgagggcgacatgccatgggtacacaaggcggatacagccggaaactgtacacaacggacaccctcagtgacgcacgccgcgcggactgccagcatacagcggccattcgcatagctggagagcgcctacaccccg

SEQ ID NO: 454342 - DNA, 873 bp, Homo sapiens
  misc_feature (45)..(45): n is a, c, g, or t
ttttttttttttcccatggccggaatcacgaacatgaacatcaanagggattcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454343 - DNA, 852 bp, Homo sapiens
ggaataaatcatctcagagtggctcgcgttcttatttaagcagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454344 - DNA, 1039 bp, Homo sapiens
  misc_feature (1012)..(1012): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcacacaaggtaagccactcattctcattcggaagcctaagacgtcctggagtcttagtgttcttgccagcgggtacggttcttaaatacgtttagctaagactggtgggcaacgattaggtaaaggggacgtggacgggtattacccggatcgcctgtgttttattttttttangtgattactagtatatatgtatgtgtt

SEQ ID NO: 454345 - DNA, 1018 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctccaccccaaacaacggtagccccatccagtaacaatcggaaaggctaaggacggcatgcagccaaacggaccctggacccgggggaaaggccccaaacaaaaaggcccgagacaactaaacacccggggcggcccgccagaggcggcgacaaggaagcccagcgcccaagtgacaccccc

SEQ ID NO: 454346 - DNA, 982 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctacgcggggttcgttaatcgcggtatttcaggcctgaagggggatctcccaacgcacgggtacgccatccttcttttccggagggccaaagccgccggacgcttaggcagcctggcacgctggcgaaggcccttggactgtgcgg

SEQ ID NO: 454347 - DNA, 986 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcacaatctgggaggcgtaggccggcatggagccttagtgacccttgacacgggggaaggcccctcaaaaaaggccctgacacagatcaaacaaaaaacacacggacaacaaaaacaggcgggcgccaatagggggaccccccatgccg

SEQ ID NO: 454348 - DNA, 976 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagcttagtagcccaatcccttcaccattccgggaagggctacaggacggtccatggagctctttagtggtatctttgaagccgcatcgggtgaagggccccttacagagacagggccctgaagttgtcttcccctctggggg

SEQ ID NO: 454349 - DNA, 980 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctgaatgcgaatctccaaaaaaatggtagccaatcattcacattcgaaagtctatatcgtcctgaaaacttcaagtacacttgaccgctgggtagggcccctaatggtcctaatatccttacccgggggggcccacctggttct

SEQ ID NO: 454350 - DNA, 951 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcccttattgcccattctccagtcttaaggccgatcatccacaacatggtagccactccttatccttctggcgggcttatcggcataggaccgtgttctcacacacagcgtgac

SEQ ID NO: 454351 - DNA, 831 bp, Homo sapiens
  misc_feature (18)..(18): n is a, c, g, or t
ggtataagaagaggacanaaacattgtgcgacacttttatttccaccgctcagggtccctgtcaaacctgctcctgtgccagagcgtggcccccttgcccatctgtcccggcggggctgcccgatgccaggtgacccttccgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454352 - DNA, 743 bp, Homo sapiens
ggcactctgctgagtgtcccccccgggttcccgggccggcccctggggcccttttccgcccgtgtcttcccatcatcctacctctcctcagaatgtcacgaattcgatacgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454353 - DNA, 770 bp, Homo sapiens
  misc_feature (576)..(576): n is a, c, g, or t
  misc_feature (579)..(579): n is a, c, g, or t
  misc_feature (598)..(598): n is a, c, g, or t
  misc_feature (634)..(634): n is a, c, g, or t
  misc_feature (675)..(675): n is a, c, g, or t
  misc_feature (695)..(695): n is a, c, g, or t
  misc_feature (710)..(710): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcagctttctgagctgatagtagcatattggatcctgaatgacctctgatatctggcacggagtcgtggatganaancccgaggtatctatcaaantgagaattgagagaaaccaacggtctaaggcatgantatagcagcaggtatctgaccaagaaataactacctgctgncggattcatcctgaatggtntgagctcgcttctgnatatacctgtcatgctccaggattacattcgcattatctagctctgagtgcgatatccac

SEQ ID NO: 454354 - DNA, 988 bp, Homo sapiens
ggtgccgccccgctggctggatctctgtgggtgtcgcgtgctcgtcccgtgggttgtgggtttgctcgtgtgttggtctgtgcttcggctgcgtgcgcgcgccgttgtggggtctgctttggtgtggcgtgtctgtgctcccggcggcttgtccgtcgtacaacttgtgctaccctagagagaaagaagtccaactgggtaccctcaaccggtgtgtcccgccaaaccaggcccgaggcccggcggtgcaacgtctgcaaaggccgcatttcggggtgcaagcaggacctggagcggtggcgcccctggtcggcccggacaccagactccccagaatgtcaccgatttcgtagccgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454355 - DNA, 586 bp, Homo sapiens
gatctcggaagctaagcaggtcgggcctggttagtacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454356 - DNA, 752 bp, Homo sapiens
gatctcggaagctaagcaggtcgggcctggttagtacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaacacaaaaacgaaacagaaccaacaacgcgacaagaaccacgaagaaaaaaccggggggggcgggaccaatggccaagaggggggaaaatacggcgcggttaacgcgggagggaaccgggagcaataagcccgggacctgccggggaggcgcaggccggagcaggag

SEQ ID NO: 454357 - DNA, 1203 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaagaactccaaccttcacaacagcaacaacccggggggggcggtcccaacgccaaaggagcgataaacacggcgcgttaaaccgcgggaaccggggtccactatcctgagagaccccgccagggatcgccgcgtccgccaatgaggagaccatgaagacggctcagaggctccacgg

SEQ ID NO: 454358 - DNA, 1260 bp, Homo sapiens
  misc_feature (1257)..(1257): n is a, c, g, or t
  misc_feature (1260)..(1260): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaacacaaaaagaccaacacaacaaaacaaaaacacaccccgccgggaacggcacgcccgcccacaaccaatccccaccagacagaaacgcagccgaaacacaagaggctgaaacagaccgccacgtgcgtgccaagagagggtgttccaccaccgacacagccaaccacaccacacacaaccacgacgaacccagaccccgcaccacccacacacacagcacaccgcgggnttn

SEQ ID NO: 454359 - DNA, 1086 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaacacaaaaaaactcccttcggggggggccggtccaattggcctataagagtctttctcc

SEQ ID NO: 454360 - DNA, 1221 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctctggtaacctggcccttagaaactagtctacaagacaaacaaagaacacaccaccaacacacaacaacccgcgcggggccccgcaccatcgccgcagagcataaacagacggcgccaaacgccgtgaagacgcgcgccacccacggaccagcaacccagggacaagaacacccgcacacagcgcgcaaagcgcgcgctgacccagcccacgctgattctcgtccgccgcccctcg

SEQ ID NO: 454361 - DNA, 1229 bp, Homo sapiens
  misc_feature (1107)..(1107): n is a, c, g, or t
  misc_feature (1229)..(1229): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttatgaccggccatggaggcttctaagggactccttgaccccgcggtgtaaggttcctacaataacggcccttgaacaacttaaacacaacgggggcggccaccgcatgagataaagggggctcagcggaaccgtcaaagagacactgggtaaggccctcggggcctattagccaacacaccttantgctacaacgctccacacaacacaacaccacccaccaacacaccacacgacaccaacaaacacaaagcaacaccagcagagcggcaacacaccacacagcggacgcaaacccgcaccagccn

SEQ ID NO: 454362 - DNA, 1090 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttcattaagaggaacacatccgcacgcctggggggacacgggccctcctcaaggggggagcaacacaccaaggaggtgacaacacaggggccgcacgctggaggcgcgcagaacgcaggcacccccgcggagcaagacgcgccaacaccaccgactcgtagcgcacagg

SEQ ID NO: 454363 - DNA, 1044 bp, Homo sapiens
  misc_feature (1005)..(1006): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagcttcattcactatctgcaggtctaatatcgtcatgcagctcttagtgaccctcacccggtggtgtacggccctcactggctagaccacaacaacagggcgcccaccaaagcagggcaacctgaaccccaagtacctggtgaaccacctgggttctatgccaagataggnnggacagacacacccgggccagcgtacacgatggcgacg

SEQ ID NO: 454364 - DNA, 1041 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagcttgcttagccggattcctatacttgcgctttctcagtcctaagttcgaattccacacacaatggtagcccatccattccattctgcaggctttttccgccctgcagtcttatgatctttagaccctggtgcagcccttaaacactgctttcctgaaacacacctgtgggccccccaagtagcgctgagtacggttcaccctgtc

SEQ ID NO: 454365 - DNA, 1006 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctctttaatcggcatttttcaagatctgaatgcgaatctccaaaaaaatggtagccaatcattcacattcgaaagtctatatcgtcctgaggtctaaggattttgacagggggtggaagggttcttaaaaaaggcctctaaatattacaacaggggggggacacttatgg

SEQ ID NO: 454366 - DNA, 1007 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctacccagcccggaaggcgaacatccaacaacagggagccccaccatcaccaatcgggaagccaagaacgccaggagccccacggaccctgaacgccggggacaagcccctcaaaggggccgaccactcacacaccgggcgggccaccaggatgggcggcaggggccgcac

SEQ ID NO: 454367 - DNA, 958 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcacaattccgagaggcgtaagagcggccatgcagtccttagcgacccttgaccaggaggcgaacggcccctaaagggcgcggccaaaccagggcgaccgcgcggcggaggcgacagggcc

SEQ ID NO: 454368 - DNA, 1026 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctgcccctggctaaccagggtccctttaacgcgcattttctaggccctgaatgcgaatctccaaaaaaatggtagccaatcattcacattcgaaagtctatatcgtcctgaaaacttcaagtacacttgaccgctgggtagggcccctaatggtcctaatatccttacccgggggggcccacctggttct

SEQ ID NO: 454369 - DNA, 1001 bp, Homo sapiens
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaaagaaaatgagatctaccctgtctggtcgggacttccatccctgcagatggctgatgaagagtctcgcctttctgcttattataacctgctccactgcctacgcagggattcacataaaatcgacaattatctcaagctcctgaagtgccgaatcatccacaacaacaactgctaagcccacatccatttcatctatttctgagaaggtccttaatgatccgttccattgcaagcttcttttagttgtatctcttttgaatccatgcttgggtgtaacaggtctcctcttaaaaaataaaaactgactccttagagacatcaaaataaa

SEQ ID NO: 454370 - DNA, 790 bp, Homo sapiens
  misc_feature (713)..(713): n is a, c, g, or t
  misc_feature (786)..(786): n is a, c, g, or t
ctgacgtttctataaagtaggtcataagaaccttcattccagaagtaccctcaaagacagagacaccaagaagaatcggaacatacaggctttgatatcaaaggtttataaagccaatatctgggaaagagaaaaccgtgagacttccagatcttctctggtgaagtgtgtttcctgcaacgatcacgaacatgaacatcaaaggatcgccatggaaagggtccctcctgctgctgctggtgtcaaacctgctcctgtgccagagcgtggcccccttgcccatctgtcccggcggggctgcccgatgccaggtgacccttcgagacctgtttgaccgcgccgtcgtcctgtcccactacatccataacctctcctcagaaatgttcagcgaattcgataaacggtatacccatggccgggggttcattaccaaggccatcaacagctgccacacttcttcccttgccacccccgaagacaaggagcaagcccaacagatgaatcaaaaagactttctgagcctgatagtcagcatattgcgatcctggaatgagcctctgtatcatctggtcacggaagtacgtggtatgcaagaagccccggaggctatcctatccaaagctgtagagattgaggagcaaaccaaacggcttctagagggcatggagctgatagtcagccaggtcatctgaaccgtgagactacctgctggncggacttcatcctgagatggtgatggctcgctttggtatatactgtcaatgtaccaggatactaatgcatttntctg

SEQ ID NO: 454371 - DNA, 11130 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454372 - DNA, 11294 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtgggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454373 - DNA, 773 bp, Homo sapiens
agggagcgtgcgggcggtactactggcgggaggagtaaagatggcggcgcgaggggtccgcttcgaggacggtgctgtctttctggccgcctgctctagcggggacaccgacgaggtgagaaagcttctggcaagaggtgctgatatcaacacggtcaacgtggacggcttgacagccctgcaccaggtaactcctttcttggtcttagaggcgtccagtctcctacagatgcgcctttgaccctgcgagccaccccatggggagtatcagtgttgccgccgactccttctgcatggacactgcccttttgggctaatcggtttcattcttggccagcttcctccactaatcaagtctttttctgaccccagggtcttaggaatagcgtcaccccgctgcttggtcagtgtttgtatttccctccacctacttgtgttgtcatggttactggtgatttttgtccctggtcttatccctgtagattagttatcttcacttatgtctggttggcgtgcctgcacaccgcgtcactcataggcacagtgtcatttgtttgatgccctttcagaaaattcagttgttgtgtgtccccgttatagaatatcttatatcacttaaagagtaaagccctttactgggtaaagacaagcaggtctgaaaccacacctcttgttttgttgatttgtagtacttcaaaacagtttgtgttgcctctaggctacagctcctagaacacgctggacctcgttgttttaggtatcttaacttcctt

SEQ ID NO: 454374 - DNA, 689 bp, Homo sapiens
gtttaaaaaggtgctatccctaatgcctcaaatctagtgaatcatggcatgcaaagaagtgtgaactagggctaagtcacctttgtgtagtcaatttgattgcttttcttaaatggcacccccatctccagctgtgaagttcagccatctgatttgaaaagtgcatttatagatggaaataatacaaatcagtctcttgctaatgctgttttcttttcttttttctttttttgtttttgtttttgtctcctttctctagcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggtatgaagagattttctttctttttgtatgcctgttctctgaatgcctgccaagactggatatttgagcataggcctgccccctccagatttcactacaaactcaatat

SEQ ID NO: 454375 - DNA, 224 bp, Homo sapiens
gttgctggtacaatctcataaaatgggctccagtgtttagagaaggacagtcagaggagtggccacctgtttgttgaaaattgggcttctgggaaagttgctgcacaagtgtgtggcaaggtgtgtctgaggtagcttgacctgctttcacctggaatgatttgatctgactatgaagatccaaaccaaaccaaggaatctggaatacagggacacgaatgtag

SEQ ID NO: 454376 - DNA, 9648 bp, Homo sapiens
gttgctggtacaatctcataaaatgggctccagtgtttagagaaggacagtcagaggagtggccacctgtttgttgaaaattgggcttctgggaaagttgctgcacaagtgtgtggcaaggtgtgtctgaggtagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggaggctaactccagtgtgctgagttgagacatcagcaagtgctgggcctggaatgtcagaagcagcaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454377 - DNA, 10105 bp, Homo sapiens
agggagcgtgcgggcggtactactggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggcatgtattgatgaaaatttggacatggtgaagtttctggtggagaacagagccaatgtaaaccagcaagacaacgagggctggacaccccttcatgcagcagcttcctgtggctatctcaacatagcagagtatttcattaatcacggagccagtgtaggtattgtcaatagtgaaggtgaagttccctctgaccttgcagaagagccagccatgaaggatcttcttctggagcaagtaaagaagcaaggaattgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcagacttttaattcaggctggctatgaactcaatgttcaggattatgatggctggactcccctccatgctgctgcacactggggagtgaaggaggcttgctccatcctggcagaagcactttgtgacatggatattcgaaataaactgggccagacaccatttgatgtggctgatgagggtctcgtggagcatttggagttgctccagaagaagcagaatgtgcttcgaagtgaaaaggagacacggaataaactcattgagtcagatctgaacagcaagattcagagtgggttctttaagaacaaagagaagatgctctatgaggaggagacacctaagtcccaagaaatggaggaagaaaataaagaatctagtagctccagctcagaggaggaggaaggtgaagatgaagcttctgagtcagaaactgagaaggaggcagataaaaagccagaagcctttgtcaatcattccaactctgaaagcaagagtagtatcacagagcagataccagcaccagctcaaaataccttctctgcctcttctgctaggaggttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcgaatttctgctctactggacaacaaagataaggagagagaaaacaaaagctatattagttcactagcaccccggaagctcaacagcacaagtgatattgaagaaaaggagaacagagaatcagctgttaatctagtgaggagtggctcctatacccggcagctatggagggatgaagcaaaaggaaatgaaatcccacagacaattgctccctccacctatgtatcaacttacttgaaaaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454378 - DNA, 9677 bp, Homo sapiens
aatcgagctcggccagattagcgacagcgattctaggatagtcagtagatagaattgtgaagatgataagtgtagagggaaggttaatggttgatattggcgcagataaggccacagacaattgctccctccacctatgtatcaacttacttgaaaagatccatcaagatgtgaaactcgcaagtttggtgcagagaagtgcttcatttggtagaagtagtgaccccacaagtccctacatttcagccaatcgcaattcatctcctgctacctcacccattaccattggttcatctacctctcggggcagccagtggcaacctgcctcttcttgccctgcaccaatcagtgcaaacactactgcatctgtacatcatggcaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtcctatctgactcctgtacgggatgaggaagcagagtctttacggaaagcacgctccagacaagctcggcagacacgaaggtctactcaaggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatgagaatgaagaagcagatttggatgagcagtcctctaagaggctgtccatccgagagaggaggcggcccaaggaacgacgaagaggcacaggcatcaatttctggacaaaggatgaggatgaaactgatggctctgaagaggtcaaagaaacgtggcatgaaagactttctaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454379 - DNA, 8793 bp, Homo sapiens
aggcagagagccttctcagcagatgatggaacgggaagccagagaaatgtgaagtgcgaaaagaactcagtgcttcaatgctggtttgaaaatcagaagggccatgtgaaaaggaatgtaggagcttctgcaagcagtaagcagccactaccctgcaaggcagtgggtacctgaaacctcacaggactggattcctgccaacagcctggatgagcttgaagcagattcttccccagatgctcctgataaaagccagcagcagactccttgatttcagaccgttgagaacttgaggagggaacccagcagaactgtgcagacttctgacctacaaaactgttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 454380 - DNA, 8619 bp, Homo sapiens
ctcagcaggttacatgttcgaattgacttgctagtagcatctcacctccttgagtgaaggaacgtcttcttgaaggacaacttaaaagcctactcagagtatcaagattcagtgggtagagcatcagcattcttctgctgtccttgacataggtgggtagttatgttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaactctatgagagtgctctgactgaaaaccaaaaactgaaaacaaaacttcaggaagcccagctagagctagcagatataaagtccaagcttgagaaggtggcccagcagaaacaagaaaagacctctgaccgatcatcagtgctggagatggagaaacgggagaggcgagccttggagcgcaaaatgtcagaaatggaggaagaaatgaaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctatcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg
